United States Patent 11,549,145 (METHODS AND COMPOSITIONS FOR INHIBITING AND TREATING NEUROLOGICAL CONDITIONS) - sequence listing, part 54

SEQ ID NO: 1216 - DNA, 172116 bp, Homo sapiens
gttgtgtcactgtgggaatagcagtcaccaccacaatatgctcacagtgacacgaacccccacaaaatcctcctgtccctacaggagactggtgtcaccgagtctcctcttgctggctctggcctggctctcctgctgagactgtgcattccagcgggttgttgtctgaaactgagcctgtctcagagaggactctgagcccagtgctgtacagggggctcctcctttgtcctgggggagttgcgtggaccctgtttttggtcaagggaagcatttgatggtgaaggagacctcccctcctctctttctcaggagccccctctgatgctgttgcctagtgtttcttggggctggtgctgggggctcagcagtgtctgccctgttccaggtgggactgtgggtctgttctgtttccacggggtgttctggggccgccagtgaggggctcgggatgttagcggctggtctctgtccctatggtctgggctccggttcactgctcccctgccctccaggtcggtcactgactcggttactatccagcgacctccgtggctgttcagtggtggctgcaggtctcttcccaggagaggcctgcgagagggctgggctgtctgggagccctgcattctcccgtgatgttgctgcctggatccctcatctttagagggagtgcggagcctccctgcaggtgcaggcagtgagagacacaggcggacgtgtgtcaaggcactggaggccgatttctttcagtgccttctgcctgtggaagagctgagctccctgcttctgcgcacaggaggctcccgtgtaaccaggcagtgagggcaagggcctgcatggggaagacttgggtgagcctttgtcctggaaataccagggccgggtctgagagggaggggagcgtggtcagagtgtccaggaggaaggtgatggcatgggcagtgtgtgggtgggagtgtagggtcagtgccatggctcaagggctccaggagaggaagaactcaagttgtgggcaggaggggttagggggtgggcacaggtaggaaaacctgaggctcttgtggcagaagagcggagggcctgcaggtgcagagttggcctgggaggggtgtttagagggagggacaggggtctggttgcagatcagggtgaggactgcagggtcacgtacccagggttgtttgggtgggcggcaagtgcagcaggtagaaaaggcccgaggcagggtggggtctccccagcgtgtgggctgcagggaggggctgcacagggtgttccccagaaggagggagcacagaggcactgggagggaatggagagggaaatggcagtgaccctagtgccaggcagtcccggtttggggttgatctgtgtgggaacagctccctggcctgtgtgtaagtggtggcaggaaggcaggtcccgccctggggtctggagcttatcttcttcctgtgagctgtgtgtgggtggctcctgtgggctgtgccctggacctgtggtctggtggagcccaggcttcccaggaacggcagtgctgtctgggctggagcagccttagatgccaggtcagggtggccctggggccactgcctccagctgtgtctagtgctgcagggatctcggcatgaggccccttctcccaggaggggaggcacgtgagtgagaccctaagtccataccccatggtggcttggccctcctgcagagggtctgggcagtggtaggtggctgtgtgcagatggggggtggggggtggggaggttagcccctcccagacgcaccctgctctgctccagagtgtgggcttgcccactgcagggtggctgggcctgggcttcctggtgtgcttgtggtggctgcattcccagagcagggactgaggtccagtggggtcccgggaggagtctgaagggggctccatggaggacctgccttggatggcacccctatcttggggaggacctggggtccagctgggaggaagtggagtggccacctcctgagggccttcttggggccacctcggcctgggggctctgtgattggccaccagccagtagttcttccctgcccagaccccaaagtctgtgctgccccaggaaaggaaggaagggtcagtggcctcatcaaagttggggcccacagtggtgtcccctaagaccgagtctgctcccaagcgctcgccctgcaggaggccctgagtgagggacagagacagggcagggcctttggtcctggtagactctggggcggattccagtggggagttatcacggttggggtcccccagagtgttggggtgtctctgctcctggagttggctctggatgtggggtttgtgtctgtgctgcctggggttgatattgggaggtgccggtgatccctgtctttctgaggacacttgtcagaagggtcaactccagccagaggcaatggggccacagcagaaggatgtgatcaagtccctgccgcaaaccaccggagcccccagcccttgtcctcattatccaacggggacaccgtggggctctgggtgctgggggtcatgggaaccggcaggacatgggttcagggcggctgctcccctctctggcggggcctccgactgctgccaggagtcagttttggacacagtttttctcacggtggtcgttccagttatacccactgtgactcggggctgttcagaatccgaccaggcgccctgagctctggggcctcctgggtgggggcaggggctgggctgctgggcggggaatgcttagggggctctggaggctggggctcgctttaggtgtggggtgagcactgggggccccagctagcggaacacccacagagactggggcctgcacacattccgccccggtgtgtggggtgggcccaggcccgtctgggcaggtcagcctcaatggggacggtgctcgggtcctgcctggctcctccttggggtagaggggacctatcgcctggccctggaccccctcaggccgcccctattcttgaagaaacgcaggacggtggagggtgccctggaggggagacgtctgctgccctgggtgtcaggtgcggcctcagatcctaaacgtgtcctccctgctctctctgcttccgctgacttgggacggggtttctggcctggcgagtgtcactgtggtaccagccactgctataccccactgtgatacagacagcttcagaaacctcctcgtctgtttgggagccttcccttgctggggtcagtgccccttggtcttgtctgccttgacggatcatccctcaaccctggttttggggggcctgcccctctgtctggtgtctggagtggggtccgagacagaggccagccacctcacaacccggagacaggtgttcctcccatggtgggtcccggtgggcctggatggagctgaggtctgtgcctgtatcggggaccccatatcctgctctttcatggctctgagctccccctggcaggacttcttcggggtgctgggtctgtcctctgtgggaggggctgctacccaggcccaggactgcagtggagggctcactgaggggcttttgggtctggcctgagccgctgtggggatattccactgtgagagggtcccgcacagattctcccatcctgcttctcctcccagagccaggaggggatgggagccgggggtcccagaggaggatcctggacccaggggaagggggcctcttcactgacctcccctccctccatccttccctccccgaagctgccctggcagcccccctgcaccccagcctttgtctgcactggctttgctggctctggtgtaggtaggactcaggatggtgtggaagacgtgcagccagggtggagaggaggtgggcgggacggtgggtgaagggggaggctcaccgaagatggaggagcacccgcagggccctgagccctcccccacaccgtccctggtccttccccgcagcctgccacggtgggagccccaggcagggtggaccataccctctaggaggctggcacttccctgggttcacgaagacggagcctgctgcccggtggtgcacggccccgcttcctccttcagcccttcctgatggcttcctggggataccggattcccatggggtgatgagaggagagcagaggggaggaggggcagggctgggtcctgggtaagggggtgctcgggctggggtccctggagagaagttctgtgttcctgggggccaattaggcaggtgtcctttctgtccacaccccaagggtcccggccggaggcaggtgggggaaccataaggagagggcctgtgtcctgtccccccaagtcctctagacagggtgggggctgaggggtccgccccagggccgggccaggcagtgactctgatgtggggccctggttttcgtggactggcctggggggtgcggggtacagagcaggagggggctgactctgttgggggatggcgcagtcatccctgtgttaaggccatttcctaccttggtcacctccagtgaaccctgggaaggagggggtggcctcccagtctgcagccggcctgggatctgctctcgccctggaactggggacggagacattctggaggtcagcagcctcctaggactgcaggagatcaggccagcccctagcaggggaggctgtggggattttggtgaggactgcgttgtttgggagccagtgccccactaggcacagtgacagacaccccagcagtatgtactgtcccccgccaggctgcccaccctatcttagccgcggcatgtgaggttgcccatccattggccttccgtgcagacatgaggccctgggatgttgagaacagacctcccactgagagaaccctccccacagagggcagagtacagacaacagtgaccttgagagccccaggagaagcaggtgagctggaggcctggggctgcacagcaggggcctgtctacttggcctggttgctgctatgggcagcaccactgtggtaaccatagctgtatccaccacagtctgacaccccctgacaataaccacacctggaactggaggcggggctgtcaggaggagcttcccagggaacagggagggtccagacagctgtgccaggggcccccaggactggggacatggggggctgctcagggaccagacatgcacagtgtccccctggagaggcctctgcagcctcctgggctctggggcaggcctctggtcagcaggaggctgggtgctccccggcatgtgctctcctgccctcactggtgagctcctatgtggcccagtgtgggcccagctccagtgtccactcctgtcggcctggccgagggtcccggcagaactgcgcatggctccttcttagatccctcggggagtctctctacagctgtacctggggctgggggctccacgagtggtcttttccaggtggggacgacaatggcaggtgtttctctagtggcaggtgaggggaactgtccagggcctggccctgcggaacacagcggcctctcagaggagggtgtgcgggagtcctgcctgttgggagcctggcggatgctgccctcttgattccagccaggatgtgaatccaggcaattggcaggaggtgctggaacgaggctggtgtctacagcaattctgggccccaggaattggctgttggaactggggcagctgttgggacagggttcggtgtagctggcggggaaggggccagggcacctgtggtcatgagtgaagtcacctcagagccctctgaagcccctgtttggagcagatggcatgtggggcaccagcccatccgctgtgatggccagggtgtccctagaggccgagggtctggctacaaaccctcagacctgactcttctggtcctggagagctccaagctgagaagtgtgcatggtccctgggtgtccggccagtttttgctgctagtttcatcactgtggtagtcaccgtagtcacacagtaggaggggccttcacaaaaagcccctgagtgtgcccagcggcctttcccacgcaggccctggtccaggcgtctggggcccccattgacagtggtgctgcgtcctggggatctcaggcctttctgaatcttccccgcctgccatcgagggcaggtgggtctgactcaccctcccgggctcctgtcccctccaggagggggctgaggtgatgtctggctggagggtatgcgggagtcaagcctcctggatttttagccctggggcaggtgcagggggtgggacgccttttaggggtctgggaaggcctgggttgtggggctgtccccatgggccatcttgtgttctgggggccgtcctgatccagatgtgggtgcctgctgtgatgcgaccgaggaatgtcctggaagaaggtgcccactggggagtgagacagggatttctggaaggttctttgtctctgactgtgtgaggtgagtcctctgttggcttccctggtgaggtctggaaacaagcaggactcaggacggccgggcaggatgagcgacgcccagctccggctgtccccgggaatgtcttctatcttagaaatgactcagaagaggctcaggtgtcagggccaggcaggcgagggaccatgggtgcagggacagtgcacagggccagccccgcccttctgctgcccctactctgacatggggtgctctcagggttcacacatgtggctcagccatgagggaggggcttctgggaccactgggtggacagcaggagatggtaatgtggggttggccttgtccccatctgggctggtgttagagggcagcagcgatgcagaccccacggagccatgtctggctgaactgtggggtgaccttggccatctgtttcatggtctccggggctggcgggctggagcccagcatggtcactcacaggcctgtccattgtgcctgctgccctgtgtgtttgggtcatgggctgcactgctgtggtagccaccatacccatggcgctgtgtcctcgatcaaaattgtaacatggcacgcggcggtcccctgcggggagggctgtggcatgggtttctgatggaccgtgtgatgctgtgggtataacgataactcccccaaacgtaatcataataccacagtgacacagacctcacttcaaacctaccgccaggcctggggaaacccgggatgtccagggctgacctgaggaggcagcagggcaccgaggggaggctgtgggcccagcgctctcaggtctactgcaggaacactcgggtctgtccctcgcttatgtggatagtgtccgcgtccaactgtgtcctgaggctccacctcaggctggcatctgtccctatgtccctacccaccccatggccatgtcctttcgggttcataaattgcccccaaatcacgcaggcaccattctggggctttttatattcccagggccaccagatgcctccacccagaaaggtcagatgtgggagagttccagagtcattccccaaccctggatgagcttctgcagcctcagtgctactcaggttccagcaagacctggagcaggtgcaggtgaggccggaggccaggtgaggtccaggtcaggtgaagcccaggccaggtgaggtccaggtcaggtgaggcccaggccaggtgaggtccagaccaggtgaggtccaggtcaggggaggctgaggtggatgtgtgaggcttctgcagttttctctgggtgctcaccctgcctggtgtccctgcccctcctctcagcacccactctgtgcctgcaaggtggtggcccgtgcacaggtggtggtggctgtggaggagctgggctctgcctccctgtgcgtgggcgtccctctcgggctctgcctgggcagtgtggctgagctgcttctctctggaattcactgactgtgccatccttgggggtatacagccctgcgcttgctccacatcaggccccaggagctgccagcatgtaccagcctgccctgccacacagtgtgcctgcaacctgtccggggatcccagggaggtgagtgccaccacacatcaggccttttctctttaaagtcatttctttggggatacatcatcgatgtctcatgtactaaatgtatgtctgtatcattgtgcaattgcctgtgtcatcatttatttatccaacctgggttaatgtctttgctattatgaatagtgctggactgagaattttctaaacacagctgtgtgcattttcctcttcttgcgatttagaagtttaactgctgtattcaaggtactgtaatgtattcgttctgtgcttgcttggagacttgccgactctgtgtgtctcagctcataccctcttccttccccagtagaagtaaccacaactgtgtttatgtgatcatcgttttcttaattttccttgtagtttttccaggggaaagtttatcccttaagaagacagttcattttgcctggtgtaaattttatttagaagaaatcacattaaaagtattttttgggctttcctctgttactccaattactcagcattgtcatgaactcaaccgcaaagccgcctgtagccctctactgttgtcccctggctgtctgggtttgcattgcatgaacctaccattgcttatttgactgttcttcagatggacgtttgctctgttctcagtttgagtctatgataatcagctgttctgcacatctttccccatgacgctctcagggagggctctggggctggcattgcctgagggttctgctttgtcgcagggagatcctgccagggcttttcagagtgtctgtgcccagcagcaatgcctgaaggtgcccactgaactttgtccttgcatcaggcactttctgtgtgtttgcttctgtactgctccacattctggagagtttattcagatctatgctgcaaattcatctcactgattctctctttagctgtgtctacatcagctcttaagcatcccatgatgcaatagtgtggtcacaaggcaaacttttgaaagatgacagtgtaggatagcggctgctcctccttccctgtgctcttcccacagactgccctcctgggctcattcccagccactgatcttgaacaccagtttatggaactctctgcacaggaaagcagaaacagcaaaaggccctgctcaggctctgcctgcatcccctcttgcacacctgccaaagctctttccttggggcctgtgcaagcttcccagagcctctcattttctgtttaccctgctcgctggctggtggggtggtgtttggcggggagtctggtgcattttggacattgatagacacccctggaccctacttcccagacgctcccccagcccctcagccccaggagtgggtgtgtttgcagtagggctttgggaatgggtctgtgtcactgtgggagtagcagctaccaccactacaatatcctcacagtgacacgagcccccacaaaatcctcctgtccctactggtgtcaccgaggtcccttttgctggctttggtctgttctcctgctgagactgtgcattccagcgggttgttgtctgaaactcagggtgtctcagagaggactctgagcccagtgctgtatagggggctcctcctttgtcctgggggagttgcgtggaccctgtttttggtcaagggaagcatttgatggtgaaggagatctcccctcctctctttctcgggagccccctctgatactgttgcctggtgtttcttggggctggtgctgggggctcagcagtctctgccctgttccaggtggggctgtgggtgtgttatgtttcctaggtgtgttatggggccaccattgaggagctcgggatgtcagcggctggtctctgtccctatggtatgggctccggctcactgctcccctgccctccaggtcggtcattgactcagttactatccagcagcctctgtggctgtttggtggtggctgcaggtctcttcccaggagaggcctgtgagaggactgggatgtctgggagccctgcattctcccgtgatgctgctgcctggatcccttgtctttagagggagtgcggagcctccctgcaggtgcgggcagtgagagacacgggcggacgtgtgtcaaggtgctggaggccgatttctttcagtgccttctgcctgtggaagggctgagctccctgcttctgtgcacaggaggctcccgtgtaaccgggaagtgagggcaagagcccaggcctgcctgggaaagacttgggtgagcctttgtcctggaaataccagggcttggcctgagagggggcggggtcggagtggccaggaggaaggtgagggcatgggctgtgggtggtgggagggcagggtcaatgccatggctcaggggctccaggagaagaagagttagagttgtgggcaggaggaggtagggtgtgggcacaggggggagaaactgaggctctagcgacagaagaggacagggcctgcaggtgcagggttggcctgggaggggtgtctggagtgatacacaggggtctgggtggagaccagggtagggactgcagggacaggaccccagagttttctgggtgggcagtaagagcagcagggttggaagggccccaggcagggttgggtctccccagggtgtgggctgcagggactggctgcacaggctgttcccccgaaggaggaaccagggaggacagaggcgctgggagcaaatggagaaggaaatggcagccacctgagtgccaggcggtcctggtttggggttgttctgtgtgggaacagcttcctggcctgtgtgtaagtggacgggggagggcgcccaggtctggggcaggaagcagtagcaggaaggcaggttctggccctgggggtctggagcttatcttcttcctgtgagctgtgtgtgggtggctcctgcacccggtgccctggacctgtggtctggtggagcccaggcctcccagggacagcagggcagcctgggctgcaggaacctcagggaccaggtcagggtggccctcgggcctctgcctccacttgcgacaggcgctgctgtgggaacctgggcttgaggccccttcactcatgatgggagccacgtgagtgagaccctaagtccataccccatgtggggctctgaccctcctgcagagccgctgggcaggggtgggtggggtgtgcaggtgggggtggggtggggagctcagcccctcccagaggcaccctgctctgctccagagtgtgtgcttgggcactgcagggtggctgggcctgggctgcctggtgtgcttgtggtggcttcatccccagagctgggactgaggcccagtggggtccagggaggagtctgaatggggctccaaggagcacctgccttggatggcacccttatcttggggaggacatggggtccagctgggaggaaggggagtggccacctcctggaggtctttccagggccacctcagcctgtggcctctgtgcttggcgacctgccagaagttcctcctggcccagaccccaaagtctgtgctgccccaggaaaggaaggaaaggtctgcgtcctggtcaaggtcggggtcacactggtgtcccctaagcccaagtctgctcccaaggcctcgcccggcagcaggtcctgagtgagggacagaggcagaggcagggtctttggtcctggtggactctacggcgaattccagtgggaagtcatcagggtcggggtcccccagggtattggggtgtctctgctcctggagttggctctggatgtggggtttgtgcctgtgctgcctggggttgatgttgggaggcgccggtgatgcctgtctctctgaggacacttgtcagaagggtcaactccagccaggggcactggagccacggcagaaggatgcgatcaagcccctgccccgacccgccggaatccccagctcttgtcctcccatccagtggggacactgtggggctccgcgtgctgggggtcatgggagccggcaggacatgggatcagagtggctgctgccctctctggcggggcctccggcagtggccactggacagtttttgacgtagctattctgacagtggtggttccggttatacccgctgtgactcggggctgttcggaatccgacggggcgccctgagctctggggcctcctgggtgggggctgggcttgtgggcggggtctcctgcgggggctccggaggctgtggctcattttaggtgtggggtgagcactgtgagccccagctagcggaacacccacagagaccgaggcctgcacacattccgccccggtgtgtggggtgggcccaggactctctgggcaggtcagcctcaatggggagagtgctcgggacctgcctaactcctccttggtgtacaggggacccatctcctcaccctagaccccccctcaggccgcccctgatcttgcagaaatgcaggacagggtggggtgccctggaggggagacgtctgctggcctgggtgtcaggtgcagtctcagatcctaaacgtgtcctccctgctctctctgcttccgctgacttggaatggggtttctggctgggtgagtgtcactgtggtaccagctgctgctataccccactgtgacacagacaccttcagaaacctcctggtctgtttgggggccttcccttgctgggctcaacaccccttggttttgtctggctttgacggggcgtccctcaaccctggttctggggggcctgcgcctctgtctggtgtctggaataggggtccaagtcaggggtcagctgcctcccgacctgcagaggctggagacagacgttcctctcagggtgtgggctgggtggtcctggatggagctgacatctgtgcctgtatcgggggccccatatcttgctccttcatggctcttagctccccctggcaggacctcctcagggtgctgggtctgtcctgtctgggtggggctgccacccaggcccagttgttggacgtcgtgggctggcctggggggtgcagggtgcagagcaggaaggggcgcactctggtggggcatgtcccggtcatccctgtgctcatgccatttcctgccttgggcacctgcattcaaccccggcaagggcaggggtggcctcccagcctacagcctgcctgggatctgctctcgccctggaactggggacggagccatcctggaggtcagcagcctcctaggacagcaggattccaggccagcccctagcgggaggcagtggggattttggcagggtctgcgtttttgtcagagctaccacccagaagtgacagtgagaaatgccccagcaatatgtcccgtccacagccgtctgcccaccctgtcttagccagggctagggagggtgctgtgtttctggcaggcccagcccttgaccttccttgcagggatgaggccctgagaagctgagctgctggtggtactggaagaggtctccagggcagggggttgagcattaatcgagtggcctgggtggggccggatcctcctgtaggctggtcactcagggtttggcatctctggctgatccctgcagccaggtactgccggggtactcacagtgctctgggcccactgtctgggctcacagcctcatttccagggggccgggtggtgctccaagcctcagtttccccactgtggaggggatgctgctggagggatgaggatcatagaggacaacctggcagcttctgtgcccgctgcccgtgggacccgggctgtgggatgggacaggcttccccatcagggctgggcctgccgggggcacagcactctcaaatgcccacaatgggggctccgtggctctgtgactccgtggctccgtggtgctgcctgcacctctcagggcgggaagctgcctttccctgccagcctttgatttctatctcaatcatccctgccctggagcacagacctcccactgagggaaccctccccacagagggccagaggacagacagcagccttgagagccccaggagaagcaggtgaagtggatgcctggggctgcgcagcaggggcctgtctacttggcctggttgctgctatgggcggcaccactgtggtaatcgtagccactatatccaccacagtctgacatcgcctgacaataaccacacctggaactggaggcggggctgtcaggaggagcttcccagggaacagggagggtccagacagctgagccaggggcccccaggactggggacgtggggggctgcttaggtaccagacatgcacagtgtctccctggagaggcctctgcagcctcctgggctctggggcaggcctctggtcagcaggaggctgggtgctccccggcatgtgctctcctgccctcactggtgagctcctatgtggcccagtgtgggcccagctccagcgtccactcctgtcggcctggccgagggtcccggcagaactgggcatggctccttcttaggggcctcgaggactctctctacagctgtacctggggctgggggctccacgagtggtcttttccaggtggggacgacaatggcaggtgtttctctagtggcaggtgaggggaactgtccagggcctggccctgcggaacacagcggcctctcagaggagggtgtgcgggagtcctgcctgttgggagcctggcggatgctgccttcttgattccagccaggatgggaatccaggcaattggcaggaggtactggaatgaggctggtgtctacagctattcagggtcccaggaattggctgttggaatcggggcatctgtcaagacagggtctggtatagctggcagggaagggccaggtcacctgtggtcatgagtgaggtcacctcagagccctctgaagcccctatttggaggaagatggtgtgcagggcaccagcccaggctgagatggcccaggtgtccctagaggctgagggtctgggcacaaatccttgggcccggctcttgtgctcctggagagctccaagctgaggcgtgcacacagcccctgggtttccagccagtttttgccactgggttcatcactatggtagttactgtagtcacacagcaggagggcccttcacaaaaagcccgagtgtggccagagacctttcccacgcaggccctggtccaggcatttggggcccctattgacagcggtgctgcgtcctggggatctcaggccgctgtgatgccactgaggactgtcctggaagagggtgtccactggggagagaggcagggatttctggaaggttctttgtctctgaatgtgggaggcgagtcctctgttggcttccccggtgaggtctggaaatgagcaggactcaggacggccgggcaggatgagcgacgcccagctccggctgtccccaggaatgtcttctgtcttggaaatgacccaggagaggctcaggtgtcagggccaggcaggccagggaccacaggggcagggacagtgcacagggccagcccctccctcctggtgcccctactcagacatgagggctctcagtgtccacacatgtggcccagccttgagggaggggcttctgggatcgctggcctgatggcagcagatggtgctgtgaggccgtccctgtcccatttggactggcgttgggagggcagcagcgatgcagacccctcggagccagatctggatgacctgtagggtgaccttggccatctgtttcatgatctccagggctggcaggctggagcccagcgtggtcagtcacgggcctgtccatcgtgcctgctgccctgcgggtttgggtcacaggctgcactgctgtggtagccaccatacccatggtgctgtctcctcgatcaaaatcctaacatggcacgtaccggtcccctgcagggagggctgtggcgggaggctcccagggatgggtttttgatggactctgtgacactgtggttataataactccccgaaccatagtaataccacagtgacacagacctcaccccaaacctaccgcccagcctggggaaacccgggatgtccggggctgacctgaggaggcagcagggccccatggggagggctgtggcgggaagcttccaggcatgggtttttgatggactctgtgacactgtggttataataaccagtcaaaatatcgtaataccacagtgacacagacctcattctaaacctaccggcaggcctggggaaacctgggatgtccagggctgaccggaggaggcagcagggctctgaggggaggctgtgggcccagcgctctcaggtctgctgtggggacactcgggtctatccctcgcttatgtggatagtgtccgtgcccacctgtgtcctgaggctccacctcaggctggcatctgtccctatgtccctacccaccccatggccatgtcctttcgggttcataagttgcccacaaatcacagagtcatcattctggagatttttatattcccagggccaccagctgcctccacccagaaaggtcagatgtgggagacttctagagtcattccccaaccctggatgagcttctgcaccctcagtgctactcaggctccagcaagacctggagcaggtgcaggtgaggcccgaggccaggtgaggtccaggtcaggtgaagcccaggccaggtgaagtccaggccaggtgaggtccaggccagatgaggtccaggtcaggtgaggcccaggccaggtgaagcccaggccagatgaggtccaggtcaggggaagccaaggccaggtgagttccaggacaggttaaacccaggtcaggagacgttcaggtgagttgaggcccaggtcaggtaaagcttgggacaggcgaggtccaagtcaggtgaggccaaggtcaggtgaagcccaggttaagtgaggcccaggccagtgaggtccaggtcaggggaggctgaggtggatgtgtgaggcgtctgcagttttctctgggtgctcaccctgcctggtgtccctgcccctcctctcagcacccactctgtgcctgcaaggtggtggcccgtgcacaggtggtgctggctgcggaggtgctgggctctgcctccctgtgcgtgggcgtccctctcgggctctgcctggggagtgtggctgagttgcttctctctggaattcactgactgtgccgtcctccgggatatatggccctgcgcttgctccacatcaggccccaggaactgccagcaggtacccgcctgccctgctgcacagtgagcctgcaacctgtccggggatcccagggaggtgaatgccaccacacatcagccctttatctctttaaagtcgtttatttggggatacatcatcgatgtctcatatactaaatatatgtctgtatcattgtgcaattgcctgtgtcatcgcttatttatccgacctgggttaatgtctttgctattatgaacagtgctggactgagaattttctaaacacaactgtgtccattttcctcttcttgcaatttagaagtttaactgctgttttcaaggtactgtaatgtattcgttctgttcttgttaggagacttgcccaccctgtgtatctcagttcataccctcttccttccccagcagaagtaaccaccactgtgtttatgtgatcatccttttcttggttttctttatggttttctaactgggaaatgtatcccttaagaagacagttcattttgcagggtgtaaattttatttagaagaaatcacattgaaagtattttttggagtttactttgttactccaattactcagcattgtcatgaactcaaccagagtcgcttataaccctgtacttttgtgcttgtggctgtctgggtttgcatttcatgaacctgccatcgtttatttgcctgttctccttcagatggacgtttgctttgctctcagtttggggctatgagaaacacctgttgtgcacatctttgcccatgaggctctcagggagggctctggggctggcattgcctgagggttctgctttgtcacagggagttcctgccagggcttttcagagtgtctgtgcccagcagcaatgcctgaaggtgcccactgaactttgtccttgcatcaggcactttctgtgtgcttgcttctgtgctgctccacattctggagaatttattcagatctgtgctgcaaatccatctcactgattctctctttagctgtgtctacatcagctgttaagcatcccatgatgcagcagtgtgggcacaaggcaaactttcgaaagatgacagtgtaggatagcggctgctcctccttccctgtgctcttcccacgctgtcctcctgggctcactcccagccattgatctcgaacaccagtttatggaactctctgcacaggaaagcagaaacagcaaaaggccctgctcaggctctgcccgcatcccctcttacacacccgccaaagctctttccttggggcctgtgcaagcttccccagcttgcttctcattttctgtttactctgctcgctggctggtgggtgtgatgtatggaggggagtctggtgcgttttgggcattgatggacacccctgagccctatttcccagacgctcccccagcccctcagccccagaagtggaatgcgtttgcagtagggctttgggaatggggctgtgtcactgtgggtatagcatacaccattagtacaatatcctcacagtgacacgagcccccacaaaatcctcctgtccctgcgggtgtcactgagccccatcttgctggctctggctggctctcctgctgagactgtgcattccagggggtttttgtctgaaactctgggtgtcttggagaggactctgagcccagtgctgaacaaggggctcctcctttgtcctgggggagttgcatggatcctgtcttcggtcaagggaagcgcctgctggtgaaggagacctcccctcctctgttctgccagagccccctctgatgctgttgcctggtgtttcttggttggttctggtgctgggtctcagcagtctctgccctggtccaggtgggactgtgggtctgtcctctttccatggggtgttgtgggaccaccagtgagtggcttgggatgtcagtggctgtcctctggccctatggtgtgggctcgggctcactgctcccctgcctccaggtctggcaatgactccgttactacccatcggcctccagggaggtttggtgttagactccgttgactgggcgtcttcaggtctcttcccaggagaggcctgtgagaggactgggatgtctggtagccctgcattctcctgtgatgctgctgcctggatccctcgtctttagagggagtgccgagcctccctgcaggtgcgggcagtgagagacacaggcagacgtgtgtcaaggcgctggaggccgatttctttcagtgccttctgcctgtggaagggctgagctccctgcttctgtgcacaggaggctgccctgtaaccgggcagtgagggtaagggcccaggcctgcatgggaaagacttgggtaaggctttgtcccagaaataccagagccaggcctgagaggggagtggggctggagtggccaggaggaatgtgagggcatgggcagtgtgtgggtgcgagggcacggtcaatgccatccctcaggggccctaggagaggaagagctcgagctgtgggcaggaggagcacgggggtgggcacaggcaggagaaactgagggtctttggcagtggaggggagggcctgcaggtgtagggttggcctgggagaggtgtttagagggaggaagacgggtctaggtagagaactgggtgggggctgtagggacaggaccccagggctgtcttggtgggtggcaagagcagcgggggagaaagggctggaggagggtcaggtctccccagggtgtgggctgcagggtcgggtctccccagggtgtggactgcagggaggagctgcacagggtgctcccccgaaggaaggaggagggaggaagcacagaggcattggaagtgaatggagaaggaaatggcagtgacctgagtgccaggtggtccccgtctggggttggtctgtgtgggaacagcttcctggcctgtgtgtaagtggacgggggagggcaacgaggtctggggcaggaagtcgtagcagcaaggcaggtcccgggcctgggggtctggagcttatcttcttcctgtgagctgtgtgtgggcggccccagtgtgggcggtgccctagacctgtggtctggtggagcccaggcctcccagggacagcagggcagccagggctagaggagcctgaggggccaggtcagggtggccctggggccactgcctctacctgtgaccagcgctgctggggggatctgggcatgagaccccttctcccaggaggggaggtgcgtgagtgagaccctaagtccatatcccatgggggctctgaccctcctgcagggggcccgggcaagggtgggtggggtgtgcaggtgggggtgggggtggggagcccagcccctcccagacgcaccctgctctcctccagggtgtgggcttgggcactgcagggtggctgggcctgggctgcctggtgtgcccgtggtggctgcattcctagagtggggactgaggcccagtggggtctggagaggagcctgaagggggctccatggaggacctgccttggatggcacccctatcttggggaagacatggggtccagctgggaggaagggtagtgggccacctgctggggttccccctggggccacctcagcctgggggctctgtgcttggtgacctgccagaagttcctccctgcccagaccccaaagtctgtgctgcaccagggcaggagggaagggtctgtggcctgctcgaggtcaggcccacagtggtgtcccctaatcctgagtttgctcccaggtgctcgccccgcagcaggccccaagtgagggacagagatgggacgggagtcatcagggttggggtcccccagggtattggggtgtctctgttcctggagttggccctggatgtggggtttgtgcctgcgctgcgtggggttgatgttagggaggtgccactgatccctgactctctgaggacacttgtcagaagggtcaactccagccaggggcactggagccacggcagaaggaagccatcaagcccctgccccgacccgccggagcccccggcccttgtcctcccatccagtggggacactgtggggctccaggtgcacggggtcatgggagccggcagaacatgggtttggggtggctgctcccctctctggcggggcctccgactgtggccaggagaccgttttggacgaagcttttctcacagtggtagttccagttatacccactgtgactcggggctgttcagaatccgacggggcgccctgtgctctggggcctcctgggtgggggctgggcttgtgggcggggtctccttcaggggctctgaggctgtggctcgttttaggtgtggggtgagcactgtgagccccagctagcggaacacccacagagaccgaggcctgcacacattccgccccggtgtgtggggtgggcccaggaccctctgggcaggtcagcctcaatggggagggggcttgtgtcctgcctggctccttctctgggtagaggggacccatctcctggtcctggacccccttcagcctgcccttgttcttccagaaatgcaggacatggcagggtgccatggacaggagacgtctgctggcctgggtgtcaggtgcggcctcagatcctaaacatgtcctccctgctctctctgcattccgctgacttgggatggggtttctggcctggcgagtgtcactgtgggacgagctgctatactccactgtgacacagacaccttcagaaacttcctggtttgtttggggaccttcccttgctgggctcagcacaacttggtcttttctggccttgacggggcgtcctcatccctggttctggggggcctgcccctctgtctggtgtctggaataggcgtccaagtcaggagtcagctgcctcctggcctgcagggactagagaaaggggttcctcccagggcaggacgtggcagtcctgaatggagctgaggtctgtgcctgtatcgggggtcccatatcctgctccttcatggctctgagctccccctggcaggacatcctcggggtgctgggttcatcctctgtgggaggggctgctacccaggcccaggactgcagtggagggctcactgaggggcttttgggtcttgcctgagccgctgtggaggtattccactgtgagagggtcccgcacagattctcccatcctgcttctcctcccagagcctggaggggatgggatccgggggtcccagaggaggatcctggacccaggggaggggggcctcttcactgaactccccttcctccatccttccctccccaaagctgccctggcggcccccctgcaccccagcctctgtctgcactggctgtgccggctctggtgtaggtgggacttaggatggtgtggacgacgtgtggccagggtggagaggaggtgggtgagtccgtgggtgagagagatgggctcatccaagatggagcacccgcggggccctgagccctcccccacaccgtccctggtccttccctgcagcctgccactgtgggagccataggcagggtggaccataccctctaggaggctggcacctccctgggttcacaaagacggagcctcctgcctggtggtgcagtggccccacttcctccctcagcccttcctgatggcttcctggggattctggattcccatggggtgatgagaggagagcagatgggaggaggggcagggctgggtcctgggtaagggggtgctcgggctggggtccctggagagaagttctgggctcctgggggccaatcaggcaagcgtcctttctgtccacaccccaagggtcccagccagagccaggtgggggaaccataaggagagggcgtgtcctgtcctccccagtcctctagacagggtgggggctgaggggtcctccctagggcagcaccgggcagtgactctggtgtggggttgtcggatgtcatgggctggccttgggggtgcggggtacagagcaggagggggtggactctgttgggggatggcccggttatccctgtgttcaggccatttcctgccctggtcacctgcagtgaaccctgggaaggagggggtggcctcccagtctgcagccggcctgggatctgctctcgccctggaactggggacggagccattctggaggtcagcagcctcctaggactgcaggagatcaggccagcccctagcgggggaggccgtggggattttggcgaggactgcgttgtttgggagccagtgccccactaggcacagtgacagataccccagcaggatgtcctgtccccgccaggctgcccaccctatcttagccgcggcatgtgaggttgcccatccattggccttccttgcaggaatgaggccctgggatgttgagaacagatctcccactgagggaaccctccccacagaggggagagtgcagaaaacagcagccttgagagccccaggagaagcaggtgagctggaggcctggggctgcacagcaggggcctgtctacttggcctggttgctgctatgggcagcaccactgtggtaaccatagctgtatccaccacagtctgacaccccctgacaataaccacacctggaactggaggcggggctgtcaggaggagcttcccagggaatagagagggtccagacagctgtgccaggggcccccaggactggggacatggggggctgctcagggaccagacatgcacagtgtccccctggagaggcctctgcagcctcctgggctctgggacgggcctctggtcagcaggaggctgggtgctccccggcatgtgctctcctgccctcactggtgagctcctatgtggcccagtgtgggcccagctccagcgtccactcctgtcagcctggccgagggtcccggcagaactgggcatggctacttcttaggggcctcagagactctctctatggctgtacctggggctgggggctccatgagtggtcttttccaggtggggacatctacagcaggcatttgtctagtggcaggtgagggggactgtctgcagcctggccctacggaacacagcggcctctcagaggagggtgtgggagtcctgcctgttgggagcctgggggatgctgtcctcttgattccaaccgggatgggaatccaggcaattggcaagaggtgttggaaggaggctggtgtctacagcgattcctggccccaggaattggctgttggaatcggggcatctgtcaggacggggtctggtgcagctggcggggaaggggccagggcacctgtggtcatcagtgaggtcacctcagagccctctgaagcccttgtttgaaggcagacgatgtgtggggcaccagcccatgggctgtcatggccaagatgtccctagaggccgagggtctgggcagaaacccttgggcccggctcttctgatcctggagagctctgagcggagaagtgtgcataaaccttgggagtccggtcagtttttgctgctgggttcatcactgtggtagttactgtagtcacacagtaggaggacccttcacaaaaagcccctgagtgtgcccagaggcctttcccacgcaggccctggtccaggcgtctggggcccccattgacagtggtgctgcgtcctggggatctcagacctttctgaatcttctccgcctgccatcgagggcaggagggtctgactcacccttgcgcgctcctgtcccttccaggaggggctgaggtgatgtctggcaggagggtgtgcaggagtcagtcctcctggagtttgagccctggggcagatgcagggggtgggacgccttttaggggtctgggaagggctgggctgtggggctgtccctgtgggccatcttgtgttctgggggcagtcccgatccagatgtgggttcccactgtgatatcactgaggactgccctggaagagggtgcccactggggagagagacagagatttctggaaggtctttgtctctgcctgtgggaggtgattcctctgttggcttcccgggtgaggtttggaaaggcgcaggactcaggatggccaggcaggatgatggactcccagctccagctgtcctgggaatgtcttctgtcttggaaatgacccaggagaggcccaggtgtcagggccaggcaggccagggaccacaggggcagtgacagtgcacagggccagccccaccttcctggtgcccctactcagacatggggggctctcagggtccacacatgtggcccagccttgagggaggggcttctgggactgttggccggatggcagcaaatggtaatgtgggccggccctgtccccatccggactggtattggagggcagcagcgatgcagacctgttggactgaggtctggctgacctatgggataatcctggccatctgtttcatggtctccagggctggcaggcaggagctcagggtggtcacttgtgggcttgtctgttgtgcctgctgccctgtgtgtttgggtcacaggctgcactgctgcggtagccaccatacccatggtgctgtgtcctcagtcaaaatcctaacatggcacgcggcggtgccccacagggagggctgtggcagcaggttcccagggatgggtttttgatggactctgtgacactgtgggtataataaccactccaaaaatcgtaataccacagtgacacagacctcaccccaaacctaccgccaggcctggggaaacccgggatgtccagggctgacctgaggaggtagcagggcaccgaggggaggctgtgggcccagcgctctcaggtctactgcggggacactcgggtctgcccctggcttaggtggacagtgtccgtgcccacctgtgccctgaggctccatttcaggctgatatctgtctgtattgtccctacccgctgcatggccatgtccttttgggtttataaattgcccccaaatcacgcaggcatcattcaggctttttatattccctgggccaccaggtgcctccacccagaaagctgagatgtgggaggttctagagtcattctgcaaccctggatgagcccctgcagcctcagtgctactgaggttccagcaagacctggagcaggtgcagatgaggcctgaggccaggtgaagcccaggccaggtgaggtccaggccagtgaggcccaggtcagatgaggcccaggtcaggtgaagcccaggtcaggtgaaacccaggtcaggtgaggcccagatcatgtgagctcaggacaggcaaggtccaagtcaggtgaggccgagctcaggtgaagcccagaggtgaggtctaggccaggtgaggtccaggccaggtgaggtccaggtcaggtgaggcccaggtcaggcaaggctgaggtagatgtatgagacttctgtaattttcagttggtgccaaccctgcctggtgtccctgcccctcctcccagcccatgctctgtgcctgccagatggcggcccctgcacaggtgctgctggctgtggaggagctgggctctgcctccctgtgcatgggcgtccctctcgggctctggcctgggagtgtggctgagttgcttgtctccggaatgtaccaactgtgccgtccttgggggtatatgtcctcggggggatacggctctgtgcctgctccacatcaggccccaggagctgccagcaggtaccagcctgccctgccacacagtgtgcctgcagcctgtccggggatgcccagggaggtgagtgccaccacatatcaggccttttctctttaaagtcatttctttggggatacatcatcaatgtctcatatactgaatgtatgtctgtatcattgtgcaattgcctgtgtcatcgtttatttatccaacctgggttaatgtctttgctattatgaacagtgctggactgagaattttctaaacacagctgtgtgcattttcctcttcttgcaatttagaattttaactgctgttttcaaggtactgtaatgtatttgttctcttcttgttaggagacttgccaaccctgtgtgtctcagttcataccctcttccttccccagtagaagtaacgaccactgtgtttatgtgatcatccttttcttgattttccttatagttttcctagtggaaagtttatcccttaagaagatagttcattttgccggctgtaaattttatttagaagaaatcacattgaaagtattttttggactttcctttgttactccaattactcagcattgtcatgaactcaaccacagagtcacctgtaaccctcactgttgtccttctggctgtctgggtttgcatttcatgaacctgccatcgtttatttgcctgttttccttcagatggctgtttgcttcattctcagtttggggctatgacaaacatatgttctgcacatctttgcccatgaggctctcagggagggctctggagctggcattgcctgcagggctctgctttgttgcagggagttcctgccaaggcttttcagagtgtctgtgcccagcctgaaggtacacactgtactttgcccttgcatcaggcactttccttgtgcttgcttctgtgtggctccacattctggagaatttattcagatctgtgctgcaaatccatttcactgattctctctttagctgtgtctacatcagctgttaagcatcccatgatgcagcattgtgggcacagggcaaactcttgaaagatgacagtgtaggatagcggctgcttctccttccctgtgcccttcccacactgtcctcctgggctcactcccagccatcgatcttgaacaccagtttatggaactatctgcacaggaaagcagaaacagcaaaaggccctgctcaggctctgcccgcatcccctcttgcacacccgccaaagctctttccttggggcctgtgcaagcttcccagctgcttctcattttctgtttactctgctcactggccagtggggtgatgtctgggggggagtctggtgcgttttgggcattgatggccacccctaggccctacttcccagacgctccccccagcccctcagctccagaagtggaagcgtttacagcagggctttgggaatggggctgtgtcactgtgggcatagcagctggtactactacaatatcctcacagtgacacgagcccccacaaaatcctcctgtccccgcgggagtcactgagtcccctcttgctgtctctggctagttctcctgctgatactatgatttccagggggtttttgtctgaaactcagggtgtgttggagaggactctgagcccagtgctgtacagggggctcctcctttgtcctgggggagttgcgtggaccctgtttttggtcaagggaagtacttgctggtgaaggagacctcccctcctttctttctcaggagccccctctgatgccgttgcctggtgtttctcagggctggtgctgggggctcagcagtgtctgccctgttccaggtgggaatgtgggtctgttctgtttccacgcggtgttctggggccgccagtgaggggctcgggatgtcagcggctggtctctgtccctatggtctgggctccggttcactgctcccctgccctccaggtcggtcactgactcagttactatccagcgggctccgtggctgttcagtggtggctgcaggtctcttcccaggagaggcctgcgagagggctgggctgtctgggagccctgcattctcccatgatgttgctgcctggatccctcgtctttacagggagtgccgagcctccctgcaggtgcgggcagtgagagacacaggcggacgtgcatcagggtgctggaggccgatttctttcagtgccttctgcctgtggaagggctgagctccctgcttctgtgcacaggaggctgccgtgtaaccgggcagtgagggcaagggcctgcatggggaagacttgggtgagcctttgtcctggaaataccagggctgggtccaagaggggagcagggtcagagtgtccaggaggaaggtgagggcatgggcagtgtgggggtgggagtgcacggtcagtgccatggctcaggggccccaggagaggaagagctcgagttgtgggcaggaggaggcagggggtaggcacagagggtagaaactgaggctctggcagcagaaaaggggagggcctgcatgtgcagggttggcctgggaggggtgtctggagggagagacaggggtctgggtggagaccagggtgtaggctgcagggatgggaccccagggttgtctggatgggcaggaagagcagcgggggagaaagggctggaggcagggttgggcctccccagggtgtggggtgcagggaggggctgcacaggctgttcccctgaaggagggaggagggagggagcacagaggtgctgggagcaaatggagagggaagtggcagcggcccgagtgccaggcggtcccggtttggggttgatctttgtggaacagctccctggcccgtgtgtaagtggtcgggggaggcacggaggtctggagctacaagcggtggcaggaaggcaggtcccagtcttgggggtctggagcttatcttcttcctgtgaactgagtgtgggcagcacctatgggcggtgccctggacctgtggtctggtggagtccaggcctcccagggacagcagggcagccagggctagaggagcctgagggtccaggtcagggtggccctggggccactgcctccacctttgaccagctctgctgtggggatctgggcatgagaccccttcacccaggaggggagccgcgtgagtgagaccctaagtccataccccatggggggctctgaccctcctgcatagggcctggacaggggtgggtggggtgtgccgggggcggtggggagcccagactctcccagacacagcctgctctgctccagaatgtgggcttgggcactgcaggctggctgggtctgggctgcctggtgtgcctgtggtggctgcattcccacagccgggactgaggcctagtgaggaccagggaggagcctgaagggagctccatggaggacctgcctcggatgacacccctatcttaagaaggtcatggtgggttccagctgggaggaagggaagtgggccacctcctgggggtcttccacccccaccacctcagcctggggcctctgtgattcctctctgcacagaccccaaagtctgtgctgccgcagggcaggaaggaagggcctgtggcctggtcgaggttggggccacagtggtgttccctaagcccgagtctggtctcatggcccgccccgcagcaggtcctgagtgagggacagagaccggggcggggtctttggtcctggtggactctggggtggattccagtggggagtcatcagggtcggtgtcccccagggtactggggtgtctctgctcctggagtcggctctggatgtggggtttatgcctgtgctgcctggggttgatgctgggaggtgccagtgacccccgtttccctgagggactcttgtcggtggtagggtcagttctggccaggagcactgggaccatagcagtaggatggggtccagccccttccatgaccccctggagccctggtccccgtcctcaccattcagtggggttcagtggggactccactgtgctctggctgctgggggtcgtgtgagctgagcaggacctaggttcggggcggctgctcccctctctggcgcggcctccagcaggggccaggagagagttttggacacagtttttctcacggtggtcgttccagttgtacccaccgtgactcggggctgttcagaatctgccccggcgccctgagctctggggcctcctggatgggggctgggcttgtgggcggcatctccttcgggggctctggaggctggggctcgctttagttgtggggtgagcactgggagccccagttagcggaacacccacagagaccggggcctgtacacattccgccccggtgtgtggggtgggcccaggcccctctgggcaggtcagcttcaacggggagggtgcttgggtcctgttagttttcctctgggttaataggattcatctcctggccccagatcctcataggctgcccctgtccctccagcaatgcaggacatggcaggtcaccctggagggaggcatgttctggcctgggcgtcaggtgtggcacctcagatcctccatgcgtgctgtgggctgagcaggacagcagacgaccccgggcccccaccctgtctatggacattttttgctgcagcagctgtgggagctgacagtgttcacagccacaccaaggtcatcattgtagtcaaggctttctaaaagtttcattgtgaggaagcctcctattaaacggcgcctgggccctgcttcctgagggttactgctgagtcccggatttcccgtagaggcgacgagaggagagcagagggaggaggagggggatgagctgggccctgcagaagggggtgcttgggttggggtctgtggagtgaagatctgggctcctaggggccacccagacaaccatcctccctgttcacaccttgagggtcccagcaggagccaggtggggagactgtgaggagagggcctgtgtcttgtcttccttgggccgtgggacagggtggaggttgagggcgtctttcccaggggatcacagaacagcacctctgctgtgggggggcatccagcacggggggctgggctgtggggtgcagggcaggagggggcgtgcacgggaggggtgtggcccagtcattcctgcattcacaatctttcttgtcctgggcacctgcactagaccctcgcctggagggggcggcttcctagcctgcagcgtccctggagtctgctctgactctggacctggggacaggagccaggcaggaggtcagcagcctcctaggacagcaggagggcccaggccagtgcctagcagacttctgctggagtggggtccccggggcagggagataatgatttctagaagtgtctgtgtctctgagtgtgcaagtttgtccaaactgtccaccaggtgtgattaggtaaacataggcagacttgagttcaggtggaggaaactgagttttgtccttaactccctaccgactctaggggaatgagccaagctccattatcatctgtgcagaggccacagccttgtaaagggaggtggtaggggagcagggagggtgctcggggctcagtcgtcggggaagggaaaagttgcccagcgctggtcagcgtccccgggatggggccagttgtgtccgtgccggccactgttgaggtcaggattctgtcctcccagagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacggtcagttctggtgcgtggagctttctcaggcaggtgttaatggggctggggtcagcctaggggtgtgacctgaagccactggaagccttgctggggtctggctctctcttggtgcggggggtggagggagccctgacaatagagcactggggggcctccaggagaccatccctgcagcagctgggccatgctctgaggaccaggagaccatccctgcagcagccgggccatgctctgaggaccaggagaccatccctgcagcagccgggccatgctctgaggatgtgggacgaggacccccactgtctctgagtgtagggtggtgacttctttgcacagactggccaggggtcccccaggggcacagtacaggtatccctgggctgcagggctgggggacatcagagcggctctctgggcttggcagccacctcaggtgggatcagaaggggaggcagtgcctggtgcttcccctccaggcctctctccatggtgtccagggtagtttctggggctttggtgccaattcctcaggccagggtcctacccttcttggtgccgtgatgcttgggggctctggaggaagccccagctttggccactcctgcactgcctggggctccagtcctgctgcgccttgaggggaacccagggccccagccttggccctgtaaggtcagatgggggctgggctccagcatcctgccgcttggtttagttcctaaatgacagggaggcagactctggctgagctcaagacctgtccccaggctctgcaccagagcagggtcccccagcagaggctgtgtggagctgggcagggttcccactttgtggggagttccctggacctggagactcaaccctcagcctccttgatgataaatgatgcgtcctgtgactgtcttggcccagaccatcagatggcctcctcacctacccctcttcagacagggcctcagacctaaggcaggagcaccccctatgccagacctcctgggtcacaggatatgcacggacattgggaagggatggaggatggacggaggaaggacgtgcagttgcagctctttctgcagatgccctgagagaggaggtaggagcacccttgctgtggtttgaatgcttctctcctccaaaactcatgttgaaatttcattgccattgtaacagtatgaagagtgattaggtcataaggtccccacctcatgggtgggattggtgctgttataaaagggtgagttcggccccctcttgctctctttcttgccttccgccatgtgatgacacagcaagaaggtcctcgccagatgctcctggacttgctttggactttcccttgctcttggacttgctctggcacctgtgctcttggacttcacagcctctagaactgtgagaaataaatttccgttcagtataaatttcccagtcttgggtattctattctaacagcacaaaacagtctaagacaaccccaaattcagacctaaggtgagataaccccaaccaatatctaaggatcccctgctccagaccttggtggtgaggtcaatacaggactccctctgagggaagccctgacagcgatgcctgggaaggcatctctagggcccagtgggccaggggaggcccaggacacacctgcatcatctctcataatccctccattctgttataacaggagcatatgcttatagcatactttaaaaattagcccaaaactgaaggtaagcatcgattaattgatggactccttttcacagtttggtctttgtatttacaccagtcatctcacaatgcgtgttgagctttgcacccttttaccaaatgaggtcaccccatgaatgctgtcatgttatcacagatatgcggtaagtataattgggaatgtttgcggaataatcccactaattttacaccacagtcatctcacaatgcgtgttgagctttgcacccttttaccaaatgaggtcaccccatgaatgctggctgtcacgttatcacagatatgtgacaagtataattgggaatgtttgcagaatagtcccactaatgtatgcaccataatttcttcaggcactatcttgctttcaactattttataattataaataatgttctgaagaatgtctgttcacaaagtgttttccttatgtgtgctagccatttgttttcttttagaaattgtgttatatcctttttgccgatttcttaagggatttgttctttttcttattagcttatgtatgttgtttgcataataatggtacaagacctttacatattagattaatattatttgagtttattatttactcttgttttgatgatttttaaatgtaaagaatctgtaaaggtgttacctagcttcatgatttgggtttgcagtgaagcctgcccaactttaggcagctgtctgggcctgtgtttccagagcttgaaggagtctctgcttccctctggagggctggtgtgatatcagtgttctctgtccaggcctgggtgccctcctgggtctgggcttgggctgggctcttagatgtctcagagaaattgagactctattaatcatctgagtctttccatttctggtgagatgatcatgggtcatcattggcctgagtggtgggatgagctataaatagttctaaattcctggtgtaagtccttgttcaacgagatggacagaatttggccttctaggatgtcatttataacatttggctctttgccaaaatgcaagttagcccatgttttactctggggactgtgaattgtgatccctttaatagactttcccatgttcctccaaatcctggagcagttcttatgggaactgattagttttgtgaaagtctaaacttcacccataaagccatcttggcctgaagtcatctgtgagggcaattatttaataatcttaatgctttcttgaggattactgttccaattatgatttccatttctccttgagtcagctttaagttttattgctagaaaagaaaaatgccaacttgccgtcatctctgctgtcactattttgtgttcaacaattgccttctctatctgctgtatctttttcagcacagaagctgtaatgttattaaacaaagcaatgtatccagatcactcagaatctatgcctgtcacggggagcaggagaagagggtgaatgaagagccacagcatggcaggggagccactgcaaggatgctgaaactcgtgtgaacagagttgctgtaggcaggctgctatggaaccttttggggaagcactgcctcttagggatggcagtgaaaatgggagaagagggtggcattgcctccagatggaagatgtagtgctttgccttgctccttggtgcttggagagggaaagggatgctgctgtaaagttcctggctggactttggcttgataaagcacgggcacctttgggagtatgagggtgggtgggtgtgcacatcttccatgaaggaactgttaatattggggcagatgtttcaagtatggcagacaaaggatgttctgcgtggggaaatgtggtgacacccatttcacaaggacagctcacatagattgagtgctcaggaaggaccagcaccatacccagtgcctgatgtgtatcatctcaattagtccttgcctcagatgcaaaaggaaaccatcgccatcatcatcaccaccatcatcatcttcctcctgtgcagatggaaaggctgaggcatagagaggtgacggagtctgcccaggactgcaagcctgctggtggcagagccaggttccaatggaatgaaggctgtcatcctcagatggcagggtaggcaggtggctagagctcacttgggagaaggggaaaggacactgactttggctagggatggagcagagcttgggctggctttccatgcacgggcagggggcgtggctcatggctacgctccagccccgggtgtggacattgaatcttccaggtctaccctaggctatgggtctggacagcactgtgatggaaagaagacactctatgtcctgcattctgtgaccaatgatgtgactgtgggaatggcgctggcatctggctgccactctgggacgggtggccagctgccatcaggccccacccaggatgggaccaccatgcgacttcttccctcgctcctcctggtcatgtccagagccccaggaggaccagcaaagcctctcgagccgatggcagctcacgttctaccttgtcagctactcctctcctgggcaacattggctgcttgctgtggctctccccggggtatgtgactgcctctgtgctgggcacctggcctgggctttccttctgggcctgggcagctgggctcagcttggacccaggcagcagccacagaggggcccatggaggtgacagagttgcttctatgatggtgaacgggcagctgtgacacggaggaggcgaccactcctcagtttccaagtgctgcggtcagggccggggccagcaaagtccctcccatattcaaagagtgggtttgggtttgtcccaggaggacatagtcaggagcccatgctggcacatgcctcctccaaagttcagcctggatccccagcctctgccaacggccccgctccttagctaacccagcttgctcctgggttccacggcggagtcagatgtttctgggcagtttcacctttgtgccttaaatgcatgttgaggactttaaggaattgtggagaaatagggctgtggcaaaggcaagtgacaactgggaacaatgatcctgcagaggctgctgaggcctgggccccaggggcgtgggttcatccttctgcctgggctttggtgggaggggcagactctgtggtctgagacacaaaaaaacccaaaacatacgtgtgtacagacacacagcagagccacacacacacttgtgcccatgcacacactcacaggaggcccgtggactccgcacagggaagaaactcctccggtcgacagtggacggcgctgcagcagggactcacccccaagccctgcctgcctcccattgcccacctggccctggcttgatgggcttatctcatgctgtggccggggacctcttgcttcctgcaaccccttgctggactggggcctgggcctctcctgggctgtgcctagggtttgtaacccagggcctgtgccggcgtgcacagagcatctctccctgggaggctcagggctgcctcctcgagctctgtgggcctgcactggccggtgagcttgtggtgtgggttttcaggctgtatccttctacctcctgagcccaggggtcccaggcgccctgcagctgtctcctcggccatcctgtggggccccgaggccttgccctcacttcagtgcctgggtgctcaggctttgcccaggtgccaggagaaggtgtgagcatgagcctattggacacacctggcgacgtataccaggtgtcccacccctgccaccatggggcctcccgatacggcaaccaccacggacctgtggggaccaatgaggaaagagagaggcaggtctgggccaggctcacagggactccggcatagcagaccctgccccagcaggcccccttgtccttcctgggtcctggtccttcatgaggaactagcccatccctggtggggctcccaccccgcttctcagtgggctctatgcttgcctcgtcggagtcacccctcaggcagtcctgggatcctctcctttagacccactgtgccttcccggcctcccgggcttctgctgggggcagaagaaatgcctccccaggtctgtctctggaggctctgagggagatgggcttgggggctgtaggaggaggcagggattccagggtgtcaggaaggcaggggtgccaggtcccacctagtgaagtaataaaccgtgggtggtgatagtgacccagtgccctcactgcccagccccgcctgtcctcagccagcactgcagggatcccaggcccagactctggaggccttcactgatcccagccaccccagaaaagctgcagcctgcaggcaccagccgggccatatgcccagtgccagctagggcccaccgcccatcctgcacacggggccgctgggcaggtgcccctcacacccccaggatgtcagtgctcacctcgagcaaagcgccccagctcggccttgggaggtggtcgtgtccagggggatgatggagagctgtccaaccaagagagcgggagggagggaaggagggagggagagagatagagagagagagagagagagagagagaggatgtgtgggccctaaggctgccttagtggaggtgcgcgtggcctgcacctcaccaagcctagccactctcgcggctctgagtggctcacaggcttgtgagggccccgtcgctgcctgctgggtccccaccagggctccctctaggaatgcgccatggctgctatgacaatttgcacagcccagtggcttaaacaccatttataccacaggtccagatgaatcctgcagggccaaggtctgggggtgctggaggccatgctccctccaggcttgcggggagaacttccctgcctcctccagtctctccatccctgagctctcggctcctcctccgtcttcagggccagggcgtagcgtctgctctctcggcctctgcctccgcttcccacctcacctggcttctgtctatgtcagtctccctctgccaacctcctagaaggacacttgtgattacattagggctcacccctttaatccaggggagcctctccacttcatgattttcagctaacttgcttctgcacagaccccctttccctataagggcacacattcactggtcccggggctaaggaccttgctccaagtccctccacccatgatgctgtgccttccagaaacctgtcctctgcagctcggtcttgaccccaagcctgctggtgacctgaacttcacagggttatccccttggactgtgtgcagcacgatgcaatttctgggcctgaatgtcatgctccctggggcaggaccttgagcctgcagcacacactaggccacctgcagtctcacaggccatgccctgggtagacagggaggtgctcaaccccagctcgggtcctctagtctgcctggctaccatgcttctcactctcctgcatctgcagaccctgcgttgccatgtgaggcaggggtggggtggggctgagggcgtggctttggtccctggctgtccggatgaagtaccagagtgacgccacagcccatcccggtgacatgctcacccccaacccccgtgtccgggaccccggtcttgtgtggtccctgatgtggagtcctcagtccttaagatacatccagaaagtcctggccatgaattggaggtgcagagtcctgcagagcctctgggctgggctggtgcccccaggagatggagggcctggtggatgccctcctccctcagagctggggcagctgcctcccaggggtgggactctgggctcagagagaggcccttgagctgcagctcagggggatgcgaggcttcgtggactgtgtcctggtccatgtggtgcacgtgtctccacctccaaggagaggctcctcagtgtgcacctcccccacatccgtcctctctgccggccccgggcgtctgagcagtcattccatgccagcacctctgcagcctgctgggcctcaggttctctgtgagggacctccccggccttcggcggaggtggagtaagctccgtcaaggcaggtggcttcgtcccttcctgtgagtgacaccagtgatgaaatggacccctccacacaggcatcctcagggcacagggccctgggggcaccttcctcctttcgtatttgttgagaaaaaaagtggcattgcgctcacaccaggatgctggagcagagctgacatgctcgggaaagggcagaggtcactgggggtgggaaggtcatccagtccagactcagcacctcgtgggctggtaaactgaggctcaaagtgctggtgccaggcctgaggcctcgcggtgacccctctctctggttcccagcacctgcctgagacctgccccaggcacccataacctggaattccctgtttccttgtccagggcctgaggaaatggctccccaggtctgtctctggatgctctgaggcagatgggcttgggggctctaggaggaggcagggactccagggtgtcaggaaggcaggggtgccgggtcccacccagtggagtaacaaactgtgggtggcgtttgggcctccccgccttccccactgggtgtgctggtgctggcgctgctgggtcagggctgcccgtgaccccagacaccactgtccatcctgtgaggctcccgtctgggcatgtcctgggtggattcctcctttctgttaagtagctacatgaggcaggggctcctggatccaaagcaaatgacaggaattccagagccaggtgcatccactcagggcagccagtgttggtggagctgcctctagcacatggaggagagtgaaagtcagcctgcccctctcacgagaaaagaacctggggatacctctcagcctccagcgttgcaagtgcaaggccagtggagttaatctgcaacgtgcacgagggcgtgtgtcagtggctgtgtgcaggagtgtgagtgagcaagagcaagagcgcatggctcctgctgtacctcaaggtgtgggctcctggtggctgctcagtgttcccaggggtgagaggcctcatgtatcctaggctgcctgagatttctgtgtgctgatcgcatcctcagtttcttgtccaccgcttcactggcaagagtcccaggctccaaggacaccctccctgcacatgattgggtgttaatggtggcctgggttgtgtcttcccctggggatgagggttgggtgtccatggtgccctgggctgtgtcctcccctagggatgagggtcgggcctccacgatgccctgggctgtgtgctcttatgggaatgagggttgggtgtccaagatgccctgggctgtgtccttccctggggatgagggttggatgtccaagatgccctgggctgtgtactcccctaggaatgagggctgggtgtccaagataccctgggctgtgtcctcccctggggatgagggttgggtgtccatggtgccctgggctgtgtcctcccctggggatgacggttgggtgtccatggtgccctgggctgtgtttccttggggatgagggttgggtgctatggcatcctgggcaggtgcttcctttctgcacaagggttgggtgaccatgatgtcctggcaatggcttccctgggttgcctcttttctgccatgtgggaagagcaggggaggtttagttggtctcagcacatcattctctcaggataagtagaagagtgtctgagctgtgaggccagtgctccagctttggaattgtcttccccaccctcacctccatcccatcaaagcccgacatgtcgtgtggcagcagcgaggtgggtgttggctgttctcttgggctgggggttagtcgtggacggggaaaggagagatgctggtcaaagggcatgaagtttctgctgatgggaggagtcagttcttttgatctgttgcacagcatggtgactatagttaacaataatgactatttcaaaattgctaaaagatgagattttaaatgttctcaccacaaaatgataagtgtgtgaggtgatggatatgccacttaccttgttttaatcatcccacaatatagacaggcattgtcactttgcattgtaccccaggaatcttcacatttgcttttttgtcaattaaaaatagagacacaaaaggagagaggggagagcaatagactcttcacggaaccgtgggcttctgcctccgggtaaaataaactgcaaaaaggattcccaggaaaccgttccctctttcagcccttggttacaggaagccggatttgggaaatctgcctggatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatataggagaaaccatggtaacgtaattagaatagtcagagaaaagtagccagaaatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatacaggagaaaacacggtaacgtaattagaatagtcagagaaaagtagccagaagaatttgcaacgtgcccttgtaacaccaaatttgatcagttttttaaaaaatgatcgttatgtaggtgattgagaagtaaatgtattcttttttaaggtaaaaatttggacccttatcatgcatacccccctctgtgctcttcaaatcaacatcattattaatatctgtacatttttgctcatctgagccagcacaggctgaggctgtcagaatggacaccttttggttgttgggtttctgtcagtttctggggtgaagctgcgtgattgagaacgtagctcttggctgccatctcggggattattaaggactgtgaactctatccacaagccatggcaatatctgtcccaccgaatgctccctctaacacactcttactcccgtgatgtgtgttaagggctccgatgatgctgaaaacagcacaggatgtgaaaaggcaggaacagttctgaagtcaaaggctgatgtcctgtttctctttccctctgtgaccgactcccttcccagtggtaacaagtacccacagcttggtttgaatttctgcacgctgttgtctgtgcactcgctcacacttacgcacacagcaggcatgtgggcgatgctgggtattttgtgtatgagtgggatgcacatacacacatctacatccatatcatgcccatgcatctgtaacttgcttttcccgtgtaagaacacttcttagagtttgttcaatgcatgtgtctgtgtgaatgattgaaggcatttctaacccattttaaagatggctacttaggaccatatggatgttgtactgatgtcatttgaccacgtccattgtttccatcttttgggctgttcttgtgtattttactttccatgtaacactgtgacattgagaattggtacctacaacagtctatttgctttacattaaatttgtaggctaatttgtgtaccttcagagtgtgaaagttttctcctgaggaaaatggggtaattcatgtttattcaggttttcttcttgtcttcccatgtgctttctagtttactttataaataataataatgtactcttactatctctcagtatacggaaagcacaagtcaaagaatatggtgtgggttctttatttaaatcttcacaacactaatcagtggcagagtgtggatccttgccccccagcacgggactagccagtggcagagtgtggatacttgtccccagcatgggactaaccagtggcagagtgtggatcctcgccccccagcacgggactagccagtggcagagtgtggatacttgtccccagcatgggactaaccagtggcagagtgtggatcctcgccccccagcacgggactagccagtggcagagtgtcgatcagacttctgggaccagtgcccattttcccaatcactgcacagtatagccttggatggcatgagctaccttggtgtctaggtcgtttgttgttcccatgaatgggttttctctttaaattacagtgctatgaataaagctgtttcacacaaataacataagcgcagtctcactattaaaatgcaaatacaaaataggaaaattggaacttacttccaacagctcacctgcagccgattgtaccttcctgtttcctgctggccacgttgtcatattttctgctaagtaaccagcccatctgcagggtctttcggggatctcaccgaggccaggtgcaaatcatcagtcttgcagtcatcaacaaacaatgctgatgataaaaccacacagaaaataccttgaaatccacagctacgcagcaacattgctcattagtacatcccattctttgaccaggggtgagggccaggcaggtacatcatttatcacttacatgataggtgcagctgtttaagtagaatttctcaggccaactccaagcccgctgtaactaaaactcacagcatggtgttggagggaaatgtttagcagcaaatatccgcatccagacagaggaaaggcctcaagtcaataaacttagcttccactttaggaaactaagaaaatagcaaattaaacttactgtaggcagtagaaaggaaatagtaaatatcagagcagaagtcaatgaaatgtaacacaaaaaactagggaaaaaaatcaataaaaccaaaaccagttttttaagaaaatcaatgaaattaaactttaggcatactgattagagaaagagagacgacacagatgagcaagatcagggatttaagaggtgccatcactacagattctacagatgttcaacctctaagagaggaatattgtttaaaaaaattttgacaataaattcaacaacttagataaaatagatacattaattgaaagacactggaaagctcactggaaaaggaagagaaaattgaatttttagttaaaaactttcccacagtctgtgtgcagtggctcatgcctgtaattccagcactgtgggaggctgaggcatgaggattacttgaggccaggagttcaagaccagcctgggcaacataataagacctcaaaaacaagacaaagcgataaacaaacaaacaaacagctgggtgtggtggtacatgcccgtagtcccagctactctgaaggctgaggtaggaggattgcttgagcccaggaggttgaggctgctgtgagctatgattacaccactgcattccagcctgggcaacagagtgagactgtgtctcttaaaaaaaaacccaaaccacaaaacaaacaaacaaagactttcccacaaagaaaactctaggccaatgacttcattatgaaatcttgcaaacctttaaggaagatataattccaattttatacaaattctttcagaaaaatgaagaggaggaaatagcttcccaactcattctgtgagtccagcattaccctgattgcaaaactaggcaaagttattataagaaaaaataccctacagactaatcttccttgtaaacatagatgtaacaattcttaacaaattttgaggaaattgaatccaacaatatgtaacaataacaacacatgatgactaaatggggtttgtctcaggaatgcaaaattgccttgatattaaagaataaataaatgtaattattcatgttaatataagaactgcataatcatcttagtagacagaaagcatttaataaattctagcatgagtgtcacattaaaagactctcagaaaattaggcataggagcaaacttcctcaatgtgatgaagggcatttataaaaaccctacagctaacatctgacaccatagtaaaagaccaaactccaacgttaggaaacaggcaagaatgtctgttttcaccacttctgtttaacattgtactggaggtcctacctgctgtaacacagaaagaaaaagacataaatttatccccactggaaaagaggaaaatctgtctctatatatagaccacatgactgtttgtatggaaaatcctatggaatctaaacagtgctgctaaaattgagaggaaatttagcaagtgtgcaggacataagatcaattcaatttccttgctgtttgaagaacttcctttagccagtctttaagagtacatcttgtagcaagaattcttttagtttttgtttatttgagaaggtatccattttctgctcatttctgaaggatagtttcattgggtatagaattcacaatcaacaattcttgaacattgaaaagtatctgagaaagactccagcatttgaattggcataattgatagctaatgcgatcatttctctcttgctgctcagtgcggtcactggggcagtgcatggaatagatggtgttcagtccatgtgtgtgaccactcaacatgtatttgagcaggtgggccaggtgggcgctgaagggaggctgagtaggtggtctggtgagtgcttgtctaagcaggacttgccagagcatagccaaatgcaggacagtgagtcgcagagtgggaggatggtttggagagagggctcaaaatgacataggggagggaaaatgtacttatatttgtttctatgtataaaggtgataagtttattgtaggaagtttgtaaattataataataaaatgatatccattcaattctacattatccaatagcatgtgccacttacaacattgagcagaacgaacagactcccccgcatggctgggttctcatctcacggctggagatccagatagggcatggccatggcataggtgtctggcaggaatctccttaaatcatccctggtcatttataaattccaaactgatgagctattatccactcagaccctactcaaatcactctgcccttcctgaccaccacccaaaccaatgcctcccaacctggtccctcttcactaacagcatggagtgtaaggaaccaccaagttcaaagcaaaggccttaaacaccctgaaaataagaatttgtaaaaacatgaatgaaactgccaatttaaaatattacctaaaaaataaatgtcaacaggatgttttattgccaagctgacaaattttaaattattaattcaaagccatagtgtattagtccattttcacaccgctataaagatactacctgagactgggtaatttataaagagaggaggtttaattgactcatagttccgcatggctggggaggcctcaggaaacttacaatcatggcagaaggtgaagggaaagcaaggcacgtcttatgtggcagcaggcgagagagagagcaggggaacctgccacttttaaaccatcatatctcatgataacaccctatcatgaaaacagcctgggaaaaaccacccttgatctaatcactcccacctggaccctccctggacacatgggaattacaattggagatgagattggggtggggacacagagccaaaccatatcacataggaacctaataggagaataaagtaggaaaacttccacatcagtaaccctttatcagttggtaatcccaatctgcaaaataaaactatgtaattttaccaagataatggaatcttctctacagaaggattttccagtgcaaaagctccccaccaccaccatgaaatgcaggtgaccatttccaatttgtgtaaagtcctcagttagtactgagacttttgaaggtcaaaaatccctttgctcatgctgcatgatctggacgagacataagaatttttagctaatagacatgcaacagcttttgtgtgaaagatgttataagacatttaaggtatttgcttatgattagtaagtatttgttgtatcattggagcacatgtgcttatataccctggaaaaattttcgtcttggaaaagtattattttggggaaaaatatcagaaaacatattgttagtctttgtttatagagtctcagccttctaaatttgaaattattggcagttttcctccaattgtaatgacaatcagccaatttaaggaggttttccagttgcagaatttttatagaggtgtcctctgctgaaatttcagtattcactacttcttaaaaacccatgcctggatggagaatgacatcagcaagatggatgaagaacttagagaagcctggtgttcacccacaccctccccatgaggaaggaataaggcaaagaagaaacagctaaggtttgactggagtgttgaagggagactgacggagtgcagtggaggtgtggaaacgcacccgtggtgatcggagggcagcatggaggcacctggcctttgcagccttgtcttccccacccagatcggattggtctggacacaggagggacttcccatgtagggaaaaggtaagcagatttcccgccagcacccactgccactgcaaacatctacagcccttgcaacaggagaattccacaggttttgcaagccctcagccaagtttgggagctgccaggaatgatcccagattaggagcacaaggtgtgtactccctgcccccattcatccactgtgagcctagctgctgcagcccagcgccaccttgagaccggagccgcctctggagtgcatcctgccctgaggctggtagccactgcccctttctagcattggggctccatcttcaggatgcccatatctgggtggctgaatgccacaaccctggctgtgcagagcctaggctgaggattggccgtgactctggccctgcacagcaaaaaacccaacccctgctgctgcacatccagctggaggaagagcctgccaggcctgcccagggtgaatccaccattgatttggccaagctgctgagggccctcccctgagcaggagaggcccctgagccaccgagcacctgatactaactccaggctggcagagtggatatgtgcccacactcaggcacctgagaaatagccctgtggcatccactccaatttccacaggtatgccgttgacctgcccaaaggctctgcacctgaaattaggcctgagaaacagcatcatgggccacccctggcaggcactcctataagccagcaagcagctgtgcgcccatgaccccggcctgagaaataaccctgtgcccctgcagccccccagcagacacacacccaggccagctgaggaagccatgtggccatgtcctgggtctgagaaagagcccatggggtggccctgggagacacatgcccaggccagttgagcggccatgcacttgtgtcctgaacctgagaaacagccctgtggattgccctcagaagccacacccccaggccagccaaagagacttgtgtttgcatcctgggcctgagaaacagccccatgtccccaaccctagtgagcctggcaccaagttggtcaatccaccatgtgcatgcatgtgcctcgacctcagaaacagcctggtgagtccacctctagcaacgttgcacttccactgccacaaacctctcagcccaggccactgagacactcgcaaacgtcaccaatgtggacggcagctgaagaaacgacatggagactacgctactgcgtcaacctagaactaaagccagcacgccccgccacactgacaccctgagacccgtctgtactaggaagtcttttcctgcaaaacctactccattaaattgcaagggatgactggtccgccagatgtgtagaaatcaacgtaggaacacataaaacatgaaaaggccaggaaacacgacacctgaaaaagacaacagtcattctccagtagcagaccccaatcataaggaaatatacagaatgtcagaaaaataattcaaaaggataatctctaagaaactcagggagatacaatagtgtacagatagaaaattcagtgaaatcaggaaaacaatttatcatttgaatgaggaattcaacaaagagataagtatcataaaaaagaaccaacagaaattccagagttgaagaattcaatgaatgaaattaaaagtacaattgagaccttcaagattagactaggccaagcaaaagagtttctgaagttgaagacagatcttttgaaataattcaggcagatgaataaaaagaaaaaaagagtaaaaaggaatgaagaaaatccccagcatttatgggacacaattaagtgaacaaatatttgcattatgggtattccaaaagagtagggaaatggtgtagaaaacacgtttaatgaaatcatagctgaaaacttcccagatccaggaggttcacagaacccaaaatagaacttctttgaggcacactgtcaaaagtcaagttgtcaaaagtcaaagacaaagaattccaaaaacagcaagagaaaaacattgtcacatattagagaatctccattagactaagaacagatttcaaaaatatgaaaaagggttttctatgatctctgttgctgagccaaaaaaaaaaaaaaaacaacaacagtttaagacacagcaagaagttccatttttgcttaactccacacctgctcctggtctgggccctgcgctggtagtgctgggtgccttctggggtcctgagcatccctgcagggaggtttgtgtctgggctcacactgacttcccctcactgtgtctcttgcacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgacaggacacctggagacaaaaggaaacagcaaagtgaaacacccctcagtctgtgaatgctgctgtgaatacggcatctccctgacactgaccccatgggaggcccagcacgggcaggaagatgaggaaggagacagacattgtctggagctctggtgactgccctggtcagccagaattcagcaggctctgcagttctgcagcgggggaggctacatttaaacaggaaaccacaccctggcatttgcctgtgtgcgtcacttgctgatataaggccccgggacggagatggctcattgaagagccggggccctcaggtctacaactgggtttccctagagccatgttcttcagcagattggatgcaaagaggagctcagaggcagggcccctgggtgtgatgactctgaaattccagcatttggcgtcctacatcaaccaaagtctatatacccttattcatagatcagatccccttcatttattcacccattcactcattcatgcaacaaatcctgagggccgatggtactaacccccaccccctggcatgaggaggcatccctaggcagatgcaccatccctgtgcccctggggccaggtgccaggtccctagagtaagaaggctcaacacccacaccaccccaggcagtcccaccacttcgggagtgaagggcagcaggtcagcattctggtccaggaaaagcctgcagtggaaaggagaggggttttgcttctgtgtggtggggcaggatggagccgagtgcagggagctgtgagcttctaaagggaggtccacagagcacagtgggcaagggcagctcatcccaaaccccaagggtggtggaaacaccccaggatggggttggatgggtgagtaggagcttttttttttttaaccacctcaatcatgaatctgcaagagtgagagctaatgacaggtgactatggcgcacacagtgtctaggaggggcctgtttctgtccagtgacactttctccttacatggccccagagtgtaacacccgagtttctgtggttctcggggcctacagttctaccctctactcctcagtactcacatgcgtcacccacaggcgttgcatctgtggggtgggaacgggggtgccaccactcctcaccacatccaaggcccactgcaggctggctgatctgtggggatttgtggttccagggcatggcaggtcagctgctttccggaggactatgggtggatatctcctgggcatggagctcaccgcacagccaagggagggctcggagtgcactggggaaaggccgcccccagggcattcctggtgactggctggggctgtgaacgtggaaactgcactgtgtgaggagagggcgaggcagtgagtgtggctgcctcccagtgatgtgggactgtgcctctgcaaggggtcgaacccgtgtcctcctgttgatggtggacccattgtcctcatccacacctccacaggtctttccctgactcactgtagaacctgactatggccccgatagacaaagactttcccgcctgcattctcggtctacagcccatcctgagcccagggcgaggtccaggcttgcacaggaaggaggcactgatgggcacggggtggactgtagccacggagggctgcacagggctgccaggcgaattagcagactcctagctcccaaatgcagggccagtttcctctcaggaacctaccctcatttccttggtagcccatttcatgcactgggctctgaagagttctggtgcaggatgaggaggtggggctgaggtctggacagacaaaggtgtgcgtcccatggggcccacatcgtggggcttgggaatgatgatgtgtccaggagagggcatagcctccacgcctcgttcttgagagggcctgtggtgtggctttggaaattggataagaatggtggccgcagctgctggtgctataagaacggtcacagctgagcagcggccacagtcccccgagagtgtcctctccaaggcatcgtgcagctgctaacaccacccacccagtgcctgcgcgtcctgaactacccagaaaacctacctcaagttgaaaggaaaaagcaaaactgtctctgttcagagattatatggttatagacatagaaaatcttaaagaatctgaaaaaaaaataaatccccaaaacaaaaacggactgttcaaactaagaaaatcaaggacatttgagcatattagcaccaaacaattggaaaattaattttgaaaggaaaaaacttgtgaagacataaaaagcaatcaggatataccttagaagaaacataaaacgatgtggagttctttacacagaaaattgtaaaacattgctcagaggctatgaacatatgaagagatacaccacatattggatgcatggattggaaaactcagtgtaattgagagacaggactagctggatttcctaggccgactaagaatccctaagcccagctgggaaggtgaccacttccacctttaaacacggggcttgcaactcagctcacacccgaccaatcagatagtaaagagagctcactaaaatgctaattaggcaaaagcaggaggtaaagaaatagccaatcatctatcacctgagagcacagcgggagggacaatgatcgggatataaacccaggcattcgagccggtaacagctaccctctttgggtcccctccctttgtatgggagctctgtcttcactctactaaatcttgcaactgcactcttctggtccatgtttgttacggctcgagcttcgctttcgctcaccgtccaccactgctgtttgcccccgtgggagacccaccgctggcttccatccctccggatccatcagggtatccgctgtgctcctgatccagcgaggcgcccattgccactctcgatcgggccaaatgctcgccattgttcctgcacggctaagtgcctgggttcgtcctaatcgagctgaacactagtcactgggttccacggttctcttccgtgacccacggcttctaatagagctataacactcactgcatggcccaagcttccattccttggaatccgtgaggccaagaaccccaggtcagagaacatgaggcttgccaccatcttggaagtggcctgcggtcattttggaagcggcctgccaccatcttgggagctctgggagcaagggccccccaataacataattaagatgccagttttccctaaataaaatctatagtttaaatttaatccaaatcaaaatcccattcaacccagcaattcaattactggaatttctccagggtataaaagcacatgtgctccaatgatacaatgaatgcttagtaatcacaagcaaataccttaaatgtctcataacatctttcacacaaaagctgttgcatgtctattagctaatgattcttacatctcatccggaccatgcagcatgagcaaagggatttctaaccttccgaagtctcagtactaactgaggactttacacaaattggaaatggtcacgtgcatttcatggtgagggtggggagcttttgcactggaaagtccttctgtagagaagattccgttatcttagtaaaatcacacagttttactttgcagattgggattactatcggataaagggttactgatgtgggaagttttcctactttattatccttttaggttcctatgtgatacggtttggctctgtgtccccaccccaatctcatctctagttgtaattctgatgtatcaaggaagggtccaggtgggaggtgattacaggcatctgccaccacgcccagctaatttttgtgtttttagtagagacaggttttgccatgttggccaggctggtctcaaagtcctgacctcaagtgatccgcctgcctcggcctcccacagtgctgggattacaggtgtgagccactgcacccgggctccaggctacacttgaagcatttcttaggttcagttcagagcagcctttagtcctgaattaatgtggcaccactactcacgagattacttcggaagattgcttgaagctttacatatctcaaggtctttccaccctggctgggagaacacaaacaatgctttccttgtgtaggctctgtgtagttttgggtccacaggtttctggtgatttccccctgatatcgagtagtttcttttcatgcaggcataagtcaggcataagtcagttctcagccccaaacctgagggatccccctccctgcggcaagtctccagctgttctccccccgccccaccccggcccatcctggctgcacagcagcctgctccccggtgctcctcccctcgggctgctgctgccttgaactctgctctctgtccgctcagctcactaagcctttccgtgtgtcctggcagctgctttcaggcaatagcaggattcgttcatttgtttttcttttctcaggggttatgatcctgtgatgcttgtttccaaatgtctgaaaactactttttcaaaacatttccacctcagtgttctatttgtttaaggaatgtgggtaagtgcattttacccacagggcttgaaccaacattcaaaattttatgttagaacctgttaaagacaaagggcaaaactgatcacaaactcaaatgcaggacagttgcactgcgattcttttttcgttaggttacagcccttatgtgttgtactccgcgggcgcaggctgagagccgtctgcacctttgttactgcggcccgacgccctcttgccagggccacagcagcatcccccgggtcaccgagccggggctttcccacgtgcctccttacaattgctatgtttctgcaagcagaggcccaaggaagtatgaagcactcctcaatatctaaattagctagcaaaactctacagggtgattaaaaaaaaaaaaaaaacaactgtgaaggtgagaggtgcagtgagtccttggcagaggccgtttgctcagggaaagtaaaaccaatgacctgactcaacgcggacacgtctgccccgccccctaaaacctgcttctggggccgctgtgtggtctggagcgccgcctggtggtcttgtgcttccctgcagggaggtttgtgtctgggctcacgctgaggtccccattctgtctcccacgggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctgaaatctctgagacactcacatggaggtacagccatcaggcagaggacgacacacagagatctcatgttttcctcaacaaggggctcgactttctcagtggcctctccaggacagaacaagaaaaaataactggctgtctctagcctgaggttgcatttcgctgggtctctgggatggaaatgtgtcttgtgtcttcaggagtctgcagggcagccgctgctgtgactcaggtagaaacttctctcccctgatgtcctggcccctcgttatccctgccacagtgcaatcagactgggcaccgctttagggagaaacggaggacatggagtgagggcagggtagtggagactattgaagagagtcaaaactctccaggggtagagacgcctccaggaccccttggcattgttttcttcactttgcaggagtaggaaggagctgagagtctagacagagcctcagatgcacaaccctgatttggcatatcggggagcaatctcatcagcccaggagaaggcccaggagaaggggcagctctttgtgcctctgcagagaagcggcagggactgggaggacattttccctgcccagcaggtggtgctgcctccttgttccctgcctggcacagcctcggggtgcagctgctggctttcccagggtctgtggagagcgtcttcttggtacttccttaacgtcaaataaagtgaatgccttctcaatgcacatcttaattcatcattggaaaggccaagacacacgcacacacacatctatatgtttttctgacaagagctagagacaattgataagtatgttatctgactgtagttcaccttaaggaggaaaaaactattaagaaatttcttaagtgtaaattgtgcctaattatgagtaaattagtaacagaagtaaaaaataataactgcagtcaacttatacactttaaaagaatactctgtgaaacaatgacgtgttatcaaaaaagggacacttaatttgttatgtgtggtgatggtcaatgagcagactcgtgttcttgctggagaagtcgcagcatccccacaggtggacttcctgcagcaatcttgtgtgtctcacacttctgtccaaagcatgtaaggggggaactcagtgcgcacaggaacctgacgcctgccatccaagggatgcgtgagcttccgtataagcagaagaagatggaaacttcagcacctgcaacagaagaggctttctgctttggggacccaaacagttccatctatggtggagatgtaggctcattcctacatcaacgtcaacaagccattggacacaacaacatttaggagtagtcgaccgcaccttctccaatgtggcctgcacagcccaggctgcagggtgggagaggtcgattctggagaaaagtcattcctgctcccctggtacactctcctcccccactgcttcatacagggaccaatgtgatgatgccatcatgatgttgaagcacacactgagccctgtaatcaattagagggctttcctatccacccatccacacacacatccacccatccactcacccgtccatccgtccaccacttatccatgcatccatccacccacccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccactcacacatccaaacatccatccactaattcatgcatctgtccacccatccagccatgcattcatccagccatcccacaatccacccacccacccacacatccaaacgtccatccactaattcatgcatctgtccacccatccagctatctgttagcaggagcgaatccatacaggtctgcagcaacttgattctcgcctccttggaggaaagaatttggccaaggggcatacagaagagtgagagacccaagcaagttttagagcaggagtaaatgtttattaaagttttaaagtgggaactaaaggaagtaaagtacacttggaagagggctaagtgggcgacttgagagatctaagtgctctgtccggcccttgacttggggttttatacattgacatggttctgggatttgtatttcttctcccttgattcttcccttggagtgggctgcccacatgtacagtggcctgccagcacttgggaggggctgcatacacagtgggtttaatgaaatgtgcacatgctcatttgaggtgtccttctcttactattagagtgttcctagaggaagattatgtgccagttaaactctgccactttgcctcttagtgcatatgcttgagcccactcacccaatgcctgagatcttatcaggaagctgctgatgaccagtttcgggtgttttctatctattgggagactgccttttcttggcgctggctgagatcaattattatttattattattattattatttgagacagagctttgctctgtcaccaggctggagtgcagtggcacaatctcagctcactgcagcctcttcctcccaggttcaagcaattctcctgcctcagcctcccgagtagctggaactatagatgcacgccaccacgcccagctaatttttgtatttttagtaaagacagggtttcaccatgttggtcaggatggtctcaatctcttgaccttgtgatccgcccacctcagcctcccaaagtgttgggattacagacatgagccaccgcgtccagccgagaccaattattattttagagaggcagtttaacaatcacttgactatcagctcatgcctgcctaactacccactctaatacatccatcccttcacatacccattcatccatccatccatccatccactcacttatctatccaagtactcatccatgcatgtagccacccacctacccacccattcatccactcacccatccatccacccatccatgcatccatcaacctacccatccacccatacatgcatccatctatcttttcactcttccatccacacacctactcagccatccatccatccatctatccatccatccatccatccatccatccatccatccatccatccatccactaatccatggttgggtccatctgtctgtgccacaaacatgcaaagataagttccatgtgacaagtctgaactcagtgttggaatcatgggaggggcaaggtggaacaggctggcttcctcaccactgttaacactgtggggagaaggccgatggcaaactcacttccatgttaaatttcctaaaagaggaaggggagtgtcatgctagagagtaatggaagctcccactgttgacacagaggtaataaatgcctgtctgatgagctaagacctgcaggaacagaaacagtcagccacatgaaaacaaggcaggaaagaggcctatggcagaagagcagctgctgaaagttcccttaggttgggcaaagctgttacgttttgaggaactaagaacagtccaagggcaagccaccgccctgtgtttctcctcttcccctgtgtctgtctgtgttccacagtgattgtgcaaactctaaatacatcgatgacccaccactgcctttatgttagaataaacaaaacagaaaacaaatatctgatgaccccacaggttgccctctttcactttgtatctctcatttctgtgcctctctctctctctctctctctctctctgtctcccttcatctggctcatctctctgtatatctttttgtcttattatttcaacaagggctcttagggtccatctaccgtgctggaaactttcttctcaccaaccattgtaagttggagaatgttttctccaccttattacaaaatgttatagctaattctcttactgcagaataatctttaatatgggtgccctgtttttagaatttaaaattagtatcaattgccattttttcacaattacaattagtattttacaaatgagttttgtaacagggcagggcattaatgaattaaattactctgtaataggaatgagaaattttattttaatatttttgagacagagtcttgctttgtctgtcaggctggagtgcggtggtatgatcttagctcactgcaacctacacctcttgggttcaaacgattatcctgcctcagccccccaagtagctcagactacaggtgcatgccaccatgcccagctaatttttgtatttttggtagatacagcgtttcaccatgttggccaggctggttttgaacttctgacctcaggtgagccacctgcctcggccttccaaagtgctgggatacaggcatgagccactgtgcccagccaagaaattttatttttaatggaccctcttagatagttcttaataatggcagtatcaaaatacatgcaattatgcatatggaagtagcttttttcctacaaacttaagaatatttcaaatcatcttctctctattcttttgaattacatgtgtgagaaacagattataagtatttcatgttattttcccagacatcactataagcatcaagtaactattcacatgtgtgccagcgatttatcatcatactcatgagggttttctatttctagaagttgcccattttttgatctctttttgctttttccttcttgtaaatattggagttcttaattcttttctaatgctgtagatcctcctagggaaggattctctacagtactacatgtgttagaatgtgggtgaaaaattatacgtgctttaaataatgaatgagccccgaaaaaaagagctggaagttgccaggtgctaggaatagacaaaattaaaaagggcatttgaattgagaatgaaacctgaatgcccccttgcatttctgaggtaggtttaacatacacaggacgggagcagccttgtgtgacttgtgggactggagctgaggtttcggcttgagtagagaggttttttttttttttttaaataattagtttctcttttgattgacacataaaaatgacctatatttattctgtacagcataatgttttgtaacatgtctacataggggagtggctccactgagctaattaacatctgtatcactcacctactccccatacggctagagaggttctaagttggcttcagccatgatgtcaggttagaaacattccctcatgaacagcagccctggacatggtagaaaagcaaaccccaagccctcgctgttcacaaagtggtcctagtgtctcacccaccatctggagctgcaaaactgagctgggaaatcactgtcgtggagtgccactggcagcacacaggtcccagcagccaggagcaaggcaccatccacagatgcctgctcccgggggaccacagctcctgtgatgaggtctcatacatagaaaccatgtgatgagcaagggaaaagcgtgtcatgacattctgaaggccacaaagagggaggtaaacctgtagagatgacagatacttcaagttactttctgatttttctaaaattataaaatagatcaacaaaaagctagagaagaatgaataattcaagaacagattttaagaaagaagaactttctgatgtgtgaaagtacccaatatgcattatcataattgtaggcattgagctctcaatgaaagaatgacctcacacttgacactcagaaggggataaataatgttggatagattgccaaagtgttctagaaagaaaataatccatctttaattttacaataccactctttctacaatgatagcgaaaaaaaaatccagatacaaatggcaggaaagtggagcatatagtttcctgctgaagctgctgttgatgaacgtgcctcacttgcatgatctcggctgtgcatagtgtgtggccagtggggagcagtgcttgtgggtggctgaataatgcatcccccaaatgtttacattcaaacccccagaacatgtggtttagtgacctcatatggcacgaggaactttgtagatgtgattaaattaatctcgagaggggagaatatggccctgcattgtctgggtgggtatgatgtaatcacaagggtgcttataagtggaagcaggagaaccagagtcaggggaagggtgatgtgatgatggacacagagatgagaggatggcctttgaagatggaagaaggggacacagagcaaggaatatgggttctagaatctggaaaaggcatgaaaacagaatctccctcccagggttcagaagaaaccagctctgccaacgctttgcctctggactaataaaaccgcaggaccaccaagaaactgctctttcttgcatagaacacagtcagtatgctcacacgacatgggtgggtttgagagttaaaggagactgcaaggtctctggctgaaacagggcaggaatcaggtggagcaagagggtgggtaggcaggacctgattttcaggagtgtaaatgtgaggcactgatgagatttccaggtggagacagagggaggagtcatgtgttcaggtctagagtggagctggtaggttggtctgagcctgagaaaggagggcatcctccaggaattgagagtaggaaaagggaagagtggataagtgctaagaactaagtgggagatttctggaggtggcggctcacagagccagcaatgtcttatggttggggtttgtaaccccagtcactgaaagtgtcctcccagcctctctctgcatatgcccctggggctgagtgcctgcgttggatggtcacttaccattccctaagaggccctaatcacctcctgcagcccagctcctcctggaccctctctctgcatatgcccctggggctgagtgcctgcgttgggtggtcacttaccattccctaagaggccctaagcacctcctgcagcccagctcctcctggaccctctctctgcatatgcccctggggctgagtgcctgcgttgggtggtcacttaccattccctaagaggccctaagcacctcctgcagcccagcccctcctggaccctctggaggggaagtttgtgtttgtgtttggtcacggagcccggctgcagagaaaacaagttttttttttttttttttctaaaggatctcactctgccacccacgctggagtgaggtggtgccatcatagctcactgcaacctcaacctcctggcctcaagccacactcccaccttggcctcccaaagtgttgcgtttacaggtgtgtgccaaggtgcccactcaaaaacgggttcttggctgggcactgtggctcaagcctgtaatcccagcaccttgggggtcaaggtgggtggatcacttgagcccaggagtttgagaccagcctgggcaacagactgtgacatgaccatttagcttatgcaaatgtgggactggttaaacggtctatgtggggctgtcgccttgtctttgcatctgtcactgaggccagaagtcagcagggcagacagttgggaaggaaagacagtgggcaagctgaggtggacagaggcagccacagggatggactgggacacatgaaggcaggcgaaaccatgttgtctctcacaccctttcaagggtctagagggagtcctttaactgattttcttccaatatatgtaattatcaggctggaggtggtgatactggagttcatagcctgactggaagctgtaaaaagcttgtacaaccttatggtgattaatttttatagccttaataagccccagaaataagactaaggcagagacttgatttaggattttgatttttgagaacatttgttatagatgctaaaaggctcaaaatatttgatcaaaacagaatcacaggccattgtaaaatgatagttactaatttaaccgaagtggtaattaaaaagactttggaggcgagtcaagatggctgactagatgcagccaggaggaatatctgccatggagggagtgagacatcaggaagacgggtgctttccaagcagatctttgaaggggaggcattgagagtggattgagagtagacgggggaggacacagatgctgagctgaaggtggaggaagatgggaaccctgcatggggatgccaagcaccaggactcattcctggctcccagcaactcctggggaaaggttgagttgaacaggtgaggagtggcctgctgttgccatgggcctccagaatcctagcagcaggagaccccatgacccccatggacacttgtgctggaagggacagctgcttagagagatgccaggggcaggactccagtctgtgtaaagcccagagtgtttgacatgagaatggctgtagtggagcacagccaggggacacccatcccccaaggctcaccaacctcctctaggagattttaaccttagagtgactatgggacctgaataaagcagggtggtcttgtccatgggacagggcccatctgaaatgagaatttccttgccttctggcctctcctggggccccaggctggctgtgcctgcttgcagtacagccttggaagcccaaccagggtgtttcctgggggccctcatcatagctcctttgccagcagaccatgcctaaccattggagacctccagcaggccagcctctgctgatgtgcaccagtccacccatagtacctcccaactgctttgctggcatgagtgcacagcagatcacaactccctctaccaccagcaagcatgtgcatgtgtgccccaccaccctgtccctgccaacacacgggcacctcactgcgctgtgactgccagcaggaacctatgtagggatgctgccactctgctcctgccagtacccccaccccagcagatgcatgtgcaccctgccatgactccacaactgctggcacccatgagtaagaatggatcccactgccaccactctaatgaagtgctttggccggcaccccctactatagtgttgtggccaatggactgggaacacctcagcccctccaatgcagcaagtttctaaactcaaggggccagagaataaagccaggggcccagtcccagagcagagaacacaccacaagagtgctgaggtgagcctggaccctctaagattttcaagaaacacagctaactgaatccactttataccacaatcaaacctgcaagagtatcaaagaagataagagcaaaaaacaaacaaatgaacaaacaaacaaaaacacacaccaaaaaacaacaaaaaagacaaaaacatccaaaggacagccacttcaaagattaaagaaacagcccacaaagatgagaaagaattaatgcaagaaactctgcaactctaaaatccagagtgtcttcttacctccaaataatcacactggtttcccagcaatggttcttaacctgactgaaatggctgaaatgacagacatagaattcagaatatgcacaggaaagaagatcactgagattcaggagaatgttgaaacccaatccaagggagctaagaaataaagtaaaatgatacagaagctgaaagatgaaatggccattttaagaaagaaccaaactgatttgatagagctaaaaaactcacttcaagaatttcagaatacaattacaagtattaacagcagaatagaccaagctgaggaaagaatcacagagcttaaaaactgattctctgaattaactcagtcagacaaaaataaagaacaaagaataaaaaagaaggcataaaacctcagagaaatgtgcaattatgtaaaaagaccagatctatgacacattggtatcccttaagaagagaaagagaaaaaaagaaacttgaaaaacatttcaggctatcctccatgaaaatttctccaacctcaccagagaggccaacattcaaattcaagaaatgcaaataacctctgcatgatattatacatgacaaccatccctaagacatatagccatcagacatcagactcttaaaggttgaaaggaaaaaaaatattagaggcagctagaaagaaggttcaggtcacatacaaagggaacccaatgaggctaacaatggaggtttcagcagaaactgtacaatccagaagagattgggggcctatattcagcattcttaaagaaaagaaattccaagcaagaatttcatatctagccaaatgaagcttcacaagtgaaggagaaataagatccttttcagacaagcaaatgctaagggtattcatcaccactagattgccttacaagaggcccttaagggattgctaaatatgataatggaagaacgttactggccaccacaaaaacacacttaagtacataacgattgccactataaatcaactatacaatcaaatctgcatattgagcagctaacaacatgataacaggatgaaatatgcacatatcaatattaaccttgaatgtaaatgggctaaatgccccaattaaagggcagagaattgccaagttggagaaagaagcaagacccaaatgtatgctgtcttcaagagacccatctcacatgcaatgacatccccaggctcaaagtaaaaggatggagaaaaatctactaagcaaatggaaaacagaaaaaagcaggtgtttctttttttaaaaatttttttattatactttaagttttagggtacatgtgcacaacgtgcaggtttgttacatatgtatatatgtgccatgttggtgtgctgcacccataaactcatcaattaacattaggtatatctcctaatgctatccctccccactccccccaccccacaacaggccctggtgtgtgatgttccccttcctgtgtccaagtgttctcattgttcaattcccacctatgaatgagaacatgcagtgtttgtctttttgtccttgtgatagtttgctgagaatgatggtttccagcttcatccatgtccctacaaaggacatgaactcatccttttttatggctgcagagtattccatggtgtatatgtgccacattttcttaatccagtctatcattgttggacatatgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccgttctaactggtgtgagatggtatctcattgtggttttgatttgcatttctctgatggctagtgatgatgagcattttttcatgtgtcttttggctccataaatgtcttcttttgagaagtgtctattcatatcctttgcccactttttgatggggttgtttgtttttcttgtaaatttgtttgagttcattgtagattctggatattagccctttgtcagataagtagattgcaaaaattttctcccattctgtaggttgcctgtttactctgatggtagtttcttttgctgtgcagaagctctttagtttaattagatcccatttgtcaattttggcttttgttgtcattgcttttggtgttttagacatgaagtccttgcccatgcctatgtcctgaatggtattgcctaggttttcttctagggtttttatggttttaggtctaacatttaagtctttaatcctcttgaattaatttttgtataatgtgtaaggaagggatccagtttcagctttctacatatggctagccagttttcccagcaccatttattaaatagggaatcgttttcccatttcttgtttttgtcaggtttgccaaaaatcagatagttgtagatatgcggcattatttctgagggctctgttctgttccattggtctgtatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagcagtttttcccaattctgtgaagaaagtcattggtagcttgatggggatgtcattgaatctataaattaccttgggcagtatggccattttcaggatattgatccttcctacccatgagcatggaatgtttttccatttgtttgtatcctcttttatttcattgagcagtggtttgtagttctccttgaagaggtccttcacgtcccttgtaagttggattccaaggtattttattctctttgaagcaattgtgaatgggagttcactcatgatttggctctctgtttgtctgttattgggttatagaaatgcgtgtgatttttgcacattgattttgtatcttgagactttgctgaagttgcttatcagcttaaggagattttgggctgagacgatggggttttctagatatacaatcatgtcatctgcaaacagcgacaatttgacttcctcttttcctaattgaataccctttatttccttctcctgcctgattgccctggccagaacttccaacactatgttgaataggagtggtgagagagggtgtctctgtcttgtgccagctttcaaagggaatgcttgtagtttttgcccattcagtatgatattggctgtgggtttgtcatagatagctcttattattttgagatacgtcccatcaatatctaatttattgagagtttttagcatgaagtgttgttgaattttgtcaaaggccttttctgcatctattgagataatcatgtgttttttgtcgttggttctgtttatatgctggattacgtttattgatttgcgtatgttgaaccagacttgcatcccagggatgaagcccacttgatcatggtggataagctttttgatgtgctgctggattcggtttgccagtattttattgaggatttttgcattgatgttcatcagggttattggcctaaaattctctttttttttgttgtgtctctgccaggctttggtattaggatgatgctggcctcataaaatgagttagggaggattccctctttttctatagattggaatagtttcagaaggaatggtaccagctcctccttgtagctctggtagaattcggctgtgaatccatctgttcctggactttttttggttgttaagctattaattattgcctcaatttcagagcctgttattggtctattcagagattcaacttcttcctggtttagtcttgggatggtgtatgtgtcgagaaatttatccatttcttctagattttctagtttatttccgtagaggtgtttatagtattctctgatggtagtttgtatttctgtgggatcggtggtgatatcccctttatcattttttattgcatctatttgattcttctctcttttcttctttattagtcttgctagtggtctatcaattttgttgatcttttcaaaaaaccagctcctggattcattgattttttgaagggtttttttgtgtctctgtttccttcagttctgctctgatcttagttatgtcttgccttctgctggcttttgaatgtgtttgcacttgcttctctagctcttttaattgtgatgttagggtgtcaattttagatttttcctgctttctcttgtgggcatttagtgctataaatttccctctacactctgctttgaatgtgtcccagagattctggtatgttgtgtctttgttctcactggtttcaaagaacatctttatttctgccttcgtttcattatgtacccagtagtcattcaggagcaggttgttcagtttccatgtagttgagtggttttgagtgagtttcttaatcctgagttctagtttgattgcactgtgctctgagagacagtttgttataatttctgttcttttacatttgctgaggagtgctttacttccatctatgtggtcaattttggaataggtgtggtgtggtgctgaaaagaatgtatattctgttgatttggggtggagagttctgtagatgtctattaggtctgcttggtgcagagccgagttcagttgctggatatccttattaactttctgtctcgttgatctgtctaatgttgacagtggggtgttaaagtctcccattattattgtgtgggaatctaagtctctttgtaggtctccaaggacttgctttatgaatctgggtgctcctgtattggatgcatatatatttaggatagttagctcttcttgttgaattgatccctttaccattatgtaatggtcttcttcgtctcttttgatctttgttggtttaaagtctcttttatcagagactaggattgcaactcctgcctttttttgttttccagttgcttggtagatcttcctccatgcctttattttgagcctatgtgtgtctctgcatgtgagatgggtctcctgaatacagcacactgatgggtcttgactctttatccaatttgccagtctgtgtcttttaattggagcatttagcccatttacattaaaggttaatattgttatgtgtgaatttgatcctgtcattatgatgttagctggttatttggctcgttagttgatgcagtttcttcctcgctttggtggtctttatgatttggcatgtttttgcagtggctggtaccagttgttcctttccatgtttagtgcttccttcaggagctcctgtagggcaggcctggtgatgacaaaatctatcagcatttgtttgtctgtaaaggattttatttctccttcacttatgaagcttagtttggatggatatgaaattctgggttgaaatttcttttctttaagaatgttgaatattggcccccactctcttctggcttgtagagtttctgctgagagatcagctgttagtctgatgggcttccctttgagggtaacccgacctttctctctggctgcccttaatattttttccttcatttcaactttggtgaatctaacaattatgtgtcttggagttgctcttctcgaggagtatctttgtggggttctctgtatttcctgaatttgaatgttggcctgtcttgctaggttggggaagttctgctggataatatactgcagggtgttttccaacttggttccattctccctgtcactttcaggtgcaccaatcagacatagatttggtcttttcacatagtctgatatttcttggagggtttgtttctttctttttacttttttttcctctaaacttctcttctcccttcatttctttcatttgatcttcaatcactgataccctttcttccagttgatcgaatcggctactgaagcttgtgcattcatcacgtagttctcataccatggttttcagctccatcaggtcatttaaggacttctctacactgattattctagttagctactcatctgatcttttttcaaggtttttagcttctttgcaatgggttccaacttcctcctttagctcggagaagtttgatcatctgaaaccttctctcaactcatcaaagtcattctccatccagctttgttccattgctggcgaggagctgcattcctttggagggggagaggcactttgatttttagaattttcagcttttctgccctgttttttccccatctttgtggttttatctaccttttgtctttgataatggtgatgtacagatggggttttcatgtggatgtcctttctgtttgttagttttccttctgacagtcaggaccctcagctgcaggtctgttggagtttgctggaggtctactgcagaccctattttcctgggtatcagcagcagaggctgcagaacagcgaatattgctgaacagcaaatgttgctgcctgataattcctctggaagcttcatctcagaggggcacccagccgtgtaaggtgtcagtctgcccctactggagggtgcctcccagttaggctactcgggggtcagggacccacttgaggaggcagtctgtccattctcagatctcaaagtccatgtgggagaaacactactctcttcaaagctgtcagacagggacatttaagtctgcagaggtttctgctgccttttgttcagctatgccctgcccccagaggtggagtctacagaggcagacaggtctccttgagctgcagtggactccacccagtttgagcttcccagccactttgtttacttactcaagcctcagcaattgtgggcacccctcccccagcctcactgccaccttgcagtttgatctcagactgctgtgctagcaataagcgaggttccgtgggcatgggaacctccaagccaggcataggatataatctcctggtgtgccatttgctaagaccgttggaaaagtgcagtattagggtgggagtgaccggattttccaggtgccgtccatcaccgcttcccttggctaggaacgggaattccctgaccccttgcacttcctgggttaggcaatgcctcgccctgcttcagctcactcttggtgggctgcacccactgtcctgcccccactgtccaacaagcccccgtgagatgaacccagtacctcagttggaaatgcagaaatcacctgtcttctgtgtagctcatgctgggagctgtagactggagctgttcctattcagccattttggaactgccccctcatagattcttgatattagacctttgtcacatgctgatgtggtttggctctgtgtcattaaacaaatctcatctcaaatagtaatccttatgtgtcaaggggtggacctggtgggaggtgactgggtcataggggtggtttcccccatgctgtcctcatgttctcctgatagtgagtgagttctcatgagatctgatggttttatccatgtatggtggttcctccttcattccctctctctctctttctctctctcacctgctgccatgtgtcacatgcctgcttccacttccaccatgattgcaagtttcctgagcctccgaccctaaccacacagcactgtgagtcaattaaacctcttttctttacaaattaaccactttcgggcagttctttatagcactgtggaaacagactaatatagtaaattggtaccaggagtggggaactgctataaagataactcaaaatctggaagcaactttggaactgggtacctcctggcagcggttggaacagtttggagaacttgaaaggagaagggaagatgtgggaaagtttggaacttcctagagacttattgagtggttttgactaaaatgctgatagtgacatgaacagtgaagtccaagctgagctggtcttaggtagtgaggactaaactctgatttttttttcatcttgcccaaattcctatctaaagagtctggggaggcatgctctacaaatcataaattctcatcagatgggttttatttaaacctatatatcatgatttactttccaaactgactctggcataacattatgagacaaataagaaaatcaaaatattttaccccaaaacatgtttctttgccatactctgagatggccctgcaggccgggcatggtggctcatgcctgtaatcccagcactttgggaggctgaggtgggcggatcacctgaggttgggagttcgagaccagcctcaccaacatggagaaaccctgtgtctactaaaaatacagaattagccgggtgtggtggtgcatgcctgtaatcatagctactcgggagactgaggcaggagaattacttgaacccaggaggtggaggttgtggtgagacaagatcgtgccattatactctagcctgggcaacaagagcaaaactccatctaaaaaagaaagaaagaaagaaagaaagaaagaaagaaagaaagaaagaaagaaagaaagaaagaaagggccctgcaaagctgttctttgtgggggaaaatttgcatctgtaaagaatctctattaacatagctagatctttttcttctagaacctcccaatcctaaagagttcaactaagatttgaataggaaacatttgtcacctattatctctaagggcagccactataagacttcaaaagaactttggactctacaatctttatcttaacctgaacattacctttctatctatcccaggtctttagacaaactcaaccaattgtcaaccagaaaatatttaaattcacctatagcctggaagccctagctttgagttgttccacctttctggaccaaaccaatgtgtctcttaaatgtatttgattgatgtctcatgcctctctaaaatgtataaaaccaagcttgatggaattttgtccctgccctagaaatctgtggaactttgcccttgagagagatgatctgaaataggaacttatttttaaaagggaaacagagcataaaagtttggaaaatttgcagcctggccatgtggtagtaaagaaaaacacatttgctagggagaaattcaagttggctgcagaaatttgcataagtaatgaagagatgaatattaataatcaagacaatggggaaaatgtttccagggcatgtcggagatctttgcagcagcccttccaatcacaggcctggaggcctatcagggaaaaatgttttcatgggctgggtccagggcccagcttctctttggagccttgggacttggtgccctgtgtcccagctgctccaggtctagctgtggctaaaaaagtccaatgtacagctcaggccattgcttcagaaagccccaatcattggtggcttctacatgatgttgggcctagggatgtgcggaagagaagagttcagctttgtgatcctccacccagatctcagaggatttatagaaatgactggatgtccagccagaagtctgcgccaggggcaaagccttcatggagagcctctgctagggcagtgcagaagggaaatgtggggttggagcccccacacagagtccccactggagacagtgactaatggggctgtgagaagagggccaccatctttcagaccccagaatggtagatccattaacggcttgcactgtgcacctggaaaagctgcatgcactcaatgagagcagccaggagggctgaactctgcaaagcccatgagagcagccatggggtcagagctgcaaagccacagggtgagagcttcccaaggttgtaggagcccccactttgcataagcatgccctgaatgtgaggaatggagtcaaaggagattattttgaagctttaagatttaatgactgccccactggagtttgggcttgcatgtgacctgaagcccctttattctggctcatttctcccaactgaaatgggagcatgtatctaatgcctgtacccccattttgtcttggaagtaactgacttgtttttcattttacaggttcatagatgaaagggacttgccttgtctccaatgtgactttggatttggacttttgagttaatactgaaatgagttaagatgttgggggactgttgggaaggcatgattggttttgaaatgcaaagaggacatgagatttgggaggggttgggtggcgtgatctggtttggctctgggtctctacccaaatgacaccattcctcagggtgatcagtgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccacatagcattgcctctgaccaaggcactccctttacggctaaagaagtgtggcagtgggctcatgctcatgggattcacttgtcttaccattttccccatcatcctgaagcagctggattgatagaagaatggaatggcctttcaaagtcacaattacaatgtcaactaggctccaatactttgcagggctggggcaaagctctccaaaaggccatgtatgctccaaatcagcatccaatatatggtactctttctcccatagccataattcatggatccaggaatcaaggggtggaagtggaaatggcaccattcaccatcacccctagtgatccactagcaaaatttttgcttcctggtcccatgacattacattctgttggcctagaggtcttagttccagtgggaataatgctgccatcaggagaaacaacaacaattccattaaactggaagtaaagatttccacctggccactttgggcccctcctacctttaagtccacaggctaagaggggagttacagtgttggctgggctgattgacctggactatcaagatgcaatcagtctattactccacaatggaggtaaggaagaatatgtatggaatacaggagatccattagggcgtctcttaacattaccatgccctgtcattaaggtcaacgggaaactacaacagcccaatccaggcaggactacaaatggcccagacccttcaggaatgaaggtttgcatcactccactaggagaaaaaactctacctgctgtgatgcttgctgaaggcaaagggaatacagaatgggtagtagaagaaggtagtcatcaataccagctacaaccacgtgatcagttgcagaaatgaggactgtaattgtcatcagtatttccttcttcttttgttaaaaacatgtttgtgcatgtacacacttgtactaagaaaattccttcatttcttttttcctttatcatgtgacataaaatttattgacttcatatcagcatttaagtgttcttaactttacataatagcatttgggttggggattggtgcatttctggttgtacaaaagatagttgtattacattaggtgtaattatgaccttattattgtctttatttgaagattatgtatgatctcaggagatttgtatgggttcaagttgacaaggggtggacttgtgatggttgatactgagtgtcaacttgattggattgaagcatgcaaagtattgatcctgggtgtgtctgtgagggtgttgccaaaggagattaacatttgagccagtaaactgggaaaggcagacccacccttaatctaggtgggcaccatctaatcagctgccagtgtggccaggatataaagcaggcagaaaaacgtgaaaagactagactggcttagcctcccagcctacatctttctcctgtgctggatgcttcctgccgtcgaacatcagacttcaaattcttcagctttgggactcggactggcttccttgctcctcagcttgcagatggcctactgtgggaccttgtgattgtgagtttaatactcctcaataaactctaatatatatataatatatataatatataatacgtattatatataatatataatacgtattatatattgtatatatacatattaggtttctctagagggacagaactatatatatatatagtttccatagtctgtggtgtagactaggtgaaatggagtttacagcctcctgaagggtaacacccagactctcacctgaattccctgaaatcctgtgccctggggattggagaaaccttaaaaccaaagccactgttaagttagctcagtctttgattgagcatggccatctgcctatacttggcttccagggctgggtgaaggagaattcctgcctggaacaagctcacattacaaagaatcttcacagtgctcatgagacatctcagaccttccatcagaagcattcaggatggcaggagactggacatgatgagcaatatggggataggaggaaggaaacagagaacggaaggaggtgacagctgacaaggccttgtgttctcagatgctgagcatgaaatgaagcatttatgatgagggaaacagaacagatgtacggtacaatattaaatataaagcagtaaattacagcaggtggcttcacagcagcttagacatagcagaagagaagaggatggaattggaagatcgatgctcaggacggatgcagagtgaagccgaggatccgacaaagaggatttgggagatgcaggctttgggagagaaggagggggattggaagaagaaagaatgtttgaaagtactccatagagaaccaggacagcccctggggccaagcagcccatgacccttgcagcttcagaggtccagactccagcctggcctcacatgctggttggtcttatccctgccaggccagaaccctcttcagaacccacttcagaacccagagcccccacagctctccctcaccctatgcccgggacatgtctcccgtgcactcttccctgccccacaggtgggagtttacacctgcttgggtggcctcggcatccacaccaacaacctgttagcagttgtcctgctccctccacctggcacagtgtgaatctcccacagtgcaggccccgtgtttgggagtgattaggacacacaggagggcaggtcaggacaacaggtgctgaggcaggcagatttccaggatttaagtgccgatgctcttggaagaccatttccatggggttaatggtggtttttcttggtgaactgttggcttgtgtttttgatattgctgttgctctaaatagtgttttcctggcttcaatacaaactctattggtcatgttctttgttaaaatacgtatcattctaaaagttcccatggcattagattttttgctcaaactacctataatatttctccaacagagtgcacatttgccttcctttcacacatacctccgccccctgccctgagcagagtcccagtggttcccatctgtttagggggtggggcaggggacacaggccctgacacgaggtggggccgtgccaagcgtggtggtcttgcacgggcactgagtgggtgggccctggagagaggagaggtcattccccctggggaacgccccaggccacaggggagaggtcagctggagcgtgaggtggggggcggagatgcataaagggtgggatggggcctgctgctctatcagcaaaacccctcacacccgaaggacacatagagggagggcactgtattcactgacctcacacttaactgtccattagcgttcagccacaaaataatagaacacactgacagaggcacaggaatggattgctcgcatctttatgacagctgaatggaggaaatttctaacaggttcagagaaaggatatcaagctgtgtttggagaaaggggtgggaattctaaacaatatctatggaagcaggacatctagaaccacagatgtattcagaaaaatgctagatctcagtactaccctagaataccaacagttttctgtggatggtatgggaagggtgatttcttccgtcggtgggctttgcctttgaaattctctctgacatatctacactgcattttaaaagtcaatattagtgtgaattttaagttaaaataaaatgttatctcattcagttatttatacatttaacttccattttcctttacaataactcagtgatacacctagccctgttttccacccggaccagcctgtgctgctacaagcctggtttctcttcctcatcacgacttactcagcttcccttcctgtttcagttcaaggaaatgtgggggcaggaagaaagggggcagctgccactcacagagctcacactaaatgacagacagcttgcccctcacgtctacctatttttctagttgaatttcattgcatgcagcaatcgacctcagggattcattttcccacatacgggaagctcggccccaggtagggggatttgcttggtgggggatttgaacccaagtccctctcactgcaaagcccacagcacccccgtgaggaacagacagggaacagggagtagccctggatcaccctaaactgacttcgggtttagagaaggacagattacctggggaatgaggaagctcattgctctggagctctcttctggagaaatgtcatgaatgttccctgtaaggagctggtggcaacttccgttaattctgggaccagagacctcaggacaagagccagatgctcattcatgtctctccaggcaagaggttctggccaagtttgggctcccagaggagtctaagaaaatgtggaaggcaccaatgtgtgtttttgaagatttatttcagagtgagcatcagcgacctacaagaacctgggacagaagccaatgcctcccgtttccctgtgatgtgaaacaggaccctgtgcttcctgtggacttcaagaaatgtggacttgagctttgccatcccttcccctgatcctgtttcatagattttgctgttatattctctgtatctttacagggatcgggaggctgaattagtgttattcagggttagtaactgtcccttccttaacggtggtggtcctgatagttcgcacatttttggctgtcccaaagagcagtgcaattatgaaggcgtaaatacgaccaaagaccactctcagatacatcactgattgctggctttgtttgacggaacgtgttctttttggaggtggcccgctgttgacactcccaccagcacctcttcttaggcacagtggaggatcccagcctatatggcaatggcagttccttctgttgttgcagactcctctatgaccgcacttctgagggtggcagttgtagcccagtgaagtgatagtcacattgcactgggtgttattacagaagtttccatgaacacaaggagtgccatctatcacacgcccaacatcagtcgtgtctgttgcatggtgttcatccagtccaaaacactgaaaccctcctctcactgagtgatggaatgaaacacgttcctgcagccggggaagatgggtcacattggtacactgcagtcttccacaaaacttatctattcctgcacaagcctggtagctgagatatgtttgttgtctaatacaatgtccaaatcggtagctttcaagatttatgtcatagcagacctcgggagcatcctcagcactgacaccaaagatcgccttgcagagcacattgcgatcagtgcagttcccacgatagcagtagccttcttcagtgcacggggttccatcttgcatataaacgtttgcgggacatgtcacggtggtcccgtgacagtactctggaaggtcacatatattttggataggtctgcagagagtccctggtggggagaagctgcagtttgtacagcactctcctatatggcagatgctccccggtgttaagtgacagtcactttggcagcaataactggcataacactgcttgaaggagccacagtcacattcctccctcccctccactatgaggtttccacagcgaaccgttgtcatggtttcgttatacacaggagcaagtgtttcaaaaacacaccggcctgaatgtataaaacaattttgtgcatgtccataagaacagttactgaacgcatctgtcatcccaggaaatcgctgcataatgcaggaggcccttctctgacatgtgcagtagttatcatcatactccagaccaatacttctcatctgtgtctgggttattatgacggctaccaataaataatgtctgcctggagtaccaatgtgtaacagggctatacgggaacagaagttatacctttcaggttcatagttagattcatgtggcacgtatttaataagtagtgtggatgaatgaacatgaaaagtatcaaaaaaagttgttttaaaataggtaaacattgcactctgaattcgatattcattcacaggggctgggtcacgattattatatatggtcaaaagataaatatagtaccgcagatcaatattttgagcaatgctgtcaatgagactgaacatctggaccacctctttggaacaagttgtaatattgccatatatgcgataatatgaattggaacattgaacgtggccttttatattgcctctatgagaactatacagcgaattagatatcctgggattcatgctgtcatttgcttcagagaacagggggtctgtctcattgtcatcatctctaaatgtgggccctgttgcgttgggctcggccactatctgaaaaacaacatgttcaaacctgcgggaatcctggaggggtttgatttcgtacgcaaggtcgtccagcctcatgatgcctctgaggtccccatagcacgtgtcgacggtgaccatggacagaggcacctcctccaggtagccgaggtactagcagtctggagggatgtaggggtcacccatctgcaagactccttggtcatcctgagttgtcaccagcagatgtctaggccaaagaaggtgtttcctccgcatgtgaatgacgtgtctttgaccccaaaacacaggctgtaggacagccagccgggaaactgaaggcctttgctatggtgtgtctccttcctgggaatcaccacctcggaggaggcatagtgccacaagggacggccttgagaacaccggaccggagccaggagcgcccagagccccagcagcaagaggggggtcctaagggtgacccgcgcctctgcccgcctcatgtcccagcccagcgatagtcatccaaagacaatgggaaaggaaaggactgtcctgggcgaagccaggccccaaccagctgcggtggctgcgtccctcccagggagaccctgacagagaacaaagggcctccccaggctcccgcaccacaccccggggggcacctggactccgggagggaatgaggtaacagtcccagggcggggcagggggtgggcctggacaggacggcagctgctgcactgcgggatgaggctgagggtcatggctgtgaggcctcatcggggagggaaaagggagagggaagcagggctgtctcttttaccaccgtcaatcttttccgtttctttctgaatctacaaaatgcaatgatgtgcgtccaatgccctcgcatcacccgtgttattctcggttgctctgtgggttaatagtgctcctttctgtggctcacactgcttactcctttgtcatgtggaggtagacactgccaatattttccttggggactgaatgtttttctactcttaataagtacccatgtcttattctttttgttgttgtgttgttttgttgtggctttgaagttttgtttgaagttaccagattgtgaaaggaaaatatcttgggccccgtcaagctggaaaccactcaggacaaatctgcctcccagtctatttaaagttgtccctctgctcacagagacaggtgcatatcctcatggcctcctttgcaaacacttatcagaaactcaaaagaatgcaaccatctgtctctcacctacctgtgacctggaagccctaagtggggaggacttgctttgagttgtctcagcctttctggatggaactaatgtccttcttacttatattgactgatgtctcatgtgtccctgaaatgcgtaaatcaagatgtgcccgaccaccttgaatccagagttcctggattcacaagatcaacagttgatatagggtaactttttcttctgtgctatgtaaaactcttgtgaattatgatactttttacttagtccatctattgggaacagatgctattcctgaccccatcagagccccaggtgctgtccctccgatgcttctgtgtggttctctcctggtctttggtcatttcttcagatgcaggagctgatcagctctcagggaagggcacagggggccctctgtgggtgtctcatgtctgagaactaacgtttcacatatttctgccaattctgtcattgcttatgaggggagggaaaatccaaggccagatcataatcagaaacacaaattactgtttcttcaaaagtgtaaatatttccctttcctggcgaatgtggtcactccatttaaacttaacgtgaccgtggtgtgtttcgaaggctgcgctgtgtggcactttgtcttccaacgccccgtactcccatcttccatcgcttcaaatcctgcctttttaccacagatgaacgattactaatgaagctggtttcccctctacgagtgtgcaggttgaacgccctttccctacccctttaaggctttcacagggaacagaaggaaaatatttgacatccctgaaggaggctgctagggaagactgtgttcctcctaaattcttgtgctgaagtcccaacccttggtcctgtccccacatggccccttccctgagatgagctcatctgtcctcttccccaaggtgagcacacctgtccccacgtggacctttccctgagacaagcacacctgtccccacatggacccttccctcagaggagcataactgtccccatgtggacccttccttcagatgaactcacctgtccccacgtggacccttccctccagaggagcacacctgtccccacgtggacccttccctcagaggagcacaccggtccccaagtggacccttccttcagacgagctcacctgtccccacgtggacccttccctcagacgaggtcacttgtccccatgtggacccttccctcagatgagctcacctgtccccacgtggactcttccctcagatgagctcacctgttcccacatggacccttccctgagacaagcacacctgtccccatgtgcacccttccctcagaggagcacacttcttccctgagaaggtggactcttccctgaggcaagaacacctgtccccaggtggaccattctctccgatgtgcacacctgtccccacatgcacccttccctgagagaagcacacctgtccctatgtggaccctttcttgatactagcacacctgtccccacatggacccttccttgagacaagcacacctgtccccacttcaacgcttctctcagatgagcacaactgtccccacctggacccttccctgagacgagctcacctgtccctacttggattcttgccttagacaagcacctctgtccccacgtggacccttccctgagagaagcacacctgtccccaggaggacccttacctcagacaagcatgcctgtccccaggtcaacccttccctcaaaagagctcacctgtccacatgaggacccttccttgagacaagcacttctgtcccctcagacaggctcacctgtccccatgtggacccttccctgagacaagcacacctgtctccatgtggaaccttccttcagacaagcacacctgtccccacatggacccttccctgagacaagcacgcctgtccccatgtagacccttccttcagaggagctctcctgtgctcagacaccaccaggggggctcagacactaatagggtggctcagacactaactgggggctcagacaccatcaggggtcctcagacactaatagggtggctcagacactaagaaggggactcagacaccaccagggggctcagacactagcaggggcactcggacaccaccagggaggatcagacataaggcggggggctcagaaaccaccagaggggctcagacaccaccagagggcgcccagcaaccaagggatgctcagaacctacggaggggcactcaggacctacaggggtcgctcaggacctggctcaggagcagatgcaaagtgaagctgaggtttccgttttctctttggggattccttgtcctgccctgcaaaagccttgctcagcagctattattgtttcttccctggaattccctagttcctctcatctgaaaaggacatagagcagaaatcccatttaacttttcacacttcattttcagtctccttctagcgatatttcagtaaaatattaataagaaataatgaagccacagtccaaatgttagcatcatgcaaagatttgtgtgtcttctccactctgtcagttatgccttaggaaactcttctctcaatccactgctcagtgtacactatgatgttgtgttttgttctttgctttcttctgctttgcagggaaatgaagcaccatttattgggacgtgtcctccatttctgatggactccccgtggtctccacctcagacggttttgccaccatctttaatccgttaatgccttcaatcgacctcaccatccatgtaatgaagcaatgaatgcctttacctcatctacttgtgtctccatgagtcagttcacttctctccattctcacaaaggacagccaacctcaggccactgcttcagagcctcctgcagccttgggtggtcaacctattaaaaagcccctgctgtttagaaaggatgtgtattggaaacttaatcccaaattccatagtgtccagaggtgggaatgttaagaaatgattaggtcatgagggctctgccctcatgaagcaatgaatgccattatcgtcagagtaggttactcattgtggtagcagattagttactacaggcctgggttcctcattaaaaaatgagtttaaacccctttccatccttcgcacctgctctcctgccttccacatggacatcacagcaagaaggctcttgccagatgctaacaccttgatattgacttcccagcctctagagctgcgagaaaataaatttcttttccttatactttagccagtgtgtggtattcactcattgcaccacaaagtggactaagacgaaaaatcagtatcaagaggtggggctgttgcgataacaaataccccaaaatgtagaagtggatgtagtaatgcacaaagactggaataatttggaggatcagactataaaaagtctggattgccctgaatagaacactagaggtgattcttttgaggactcagaagaagagagctgtgaggaaattctgaaacttcttagagattatttaggtgatgaccattagaatgtcagtagaaccgtggacaataaaggccgttctgatgaggtctcaggagaaaaagaagaatagctcatcggaaaatggagcaaaggccatccttgccataaagtggcaaagaacgtggctgaattgtgttcatccctaggtccttctgtaaggtggaagttcagagccatgaacgaggttatatggtgggagaaatttgaaggaaatctatggcctgacttctagcaggcactttaggactctgttcccggtgtccaggcacagcactccttggctgcccatgctgtggctcaggaggacctaggtgtggctcaagccatcactttaatggtacaagtcatcaacttccatggcatccatgtgttgttaattctgcaggtgtgcagaatacaagaaccacgagggcatggctttctccacctagatttcaaagaatgctgtggacggcctaaggtctcgggcagcctaaggacagcctaaggtctcgggcagtgacttgttgcagagacagagtcaccacactgggcccttagcacaatgccaagcagaaatgtgggtttggaggtaccacaaagagtttccagtcagcctaggagagctagaggcctgagagtcccacctgtgagagcggctgagtggactgaacccagaaaatatatagaggcaagactgccggaggccttgggggcccatccccctccccagtgtgcacaagatgccgttaaagaggatgattttccagctataagacttaatgtttttttccctgttgggttttgaactaggcaccgctttctccttgcctctctctgagctttggaatgggaatttctatcccatacctgccccattgttcactgtatttgaaagtagataacttgttttgactttataggctcgcagatggaaacaatttatatcaggctaaattgtgcctcgagtcacactcatatctgatttagatgagactttggacttcagacttttgcactgatgctggataagactttggagacaattgggatggaatgaatgtaatttgcattgtgataaggacataaattttgatattaggaatggaatgctatggtttaaatgtgtctcccaaagtttaggatctggaaataatctttaatgcaacagtgttgagaggtgggacctttattatgtgatcaagtcatgaaggctctgtcctcatgaatggattactgtcactatcaatggagtgggttagttattataggagtgaatttctaataaaagatggtctcttttctctcgtggacaaatggtctcttgctcacccacctctgctgtgagatgaggcagtgagaaggcccttgtgagatgccagtgccttgatattagacttctctgactcaagcaccataaagcataaattccttttctttagaaattgcccagtctctggtattcggttatagtaacaaaaagacagactgagactaagccattgtaacatgtgtgaggtgatatcttatcgtggttttaatttgcatttccctgatgattagtgatgttgagcatttgactctttatgttgagtgaaataagccaggtataaaaaattactccatgatctcacttacacatgcaatctaaaaatgttgaactcagagtagagagtagaatggtgcctaccaggggctggcgtcaggggcatgtgaaagctgagacgttggtgaaagggtacagagttttggttagatagaaggaattcgtttgaagatctattgcacagcatggtgacttccatgatactaatgtactatatacttgaaaactgataagagagtagattttacacgtttacaccataaaaaataagtatgtgaggtgatggacatgtttatttacttgatttaataatttcacaatgcccgcatatgtcaaaacatcacgtcatatccccataatatatgaaatagaatatgtttttctagtaagtgtgatgcctctgtttctttttctttcttttttttttttgggaacaaaacaataaacacctttattacatgggtgaagacaaaacaaggatttatttgcctttctgggccttgattttcctaagatagaactccaactctttgccctctagcacatagccatctgctcggccacactgtcccggccttgaagccatgcacgcaagaagcttgccctgctggaactgctcccccaggagactgctcattttggcattcttcttcctttcatcatatttcttctgaatttttttagatcgttttttgtttaaaatctcttcttcctcaggagtcagcttggctcccttcttgcggcccaggggcagtgcacagtgggactcgtaccactgtcggtagggcgtgctgtcgatgggcacgatgcaattcttcaccacggtcttggtacgaaccagctcgttattggatgcattgtagacaacatcgatgacccttgtttcaccagcgcagcattctgagccccaggagaaattccccacgtccagcctcggggcacagtatttcttgttacctcctcgcacacggactgtgtggatgcggcacgggtcagtcttgctgttggcagctgggcgccccaactcatacttccgcttcttgtggcagggccttctcttgcccccagctttgcggcccttgtgccagttgtcccgagaggtgcccatcgctcggcgctggctggaaagagggcctctgtttctttaacaatactttctggagattgtttttcccttgagcaatgtttcctctctgctgtatttacacagttttcctttcccatgggttgatttaagacagtgacaatttatttattctatgtctggtaatttcactgagaaacttaatgaatagccacttgaaaccatctggtgccactgagaaaccatctgaaggacacagattttctgagtgtaggccacaaccatattttaacactttttaaattcaaaatcggggtttaaattttgatattttactatggcttctttgattccctcccaagatctaaccattgagcgtgtgaaaagggctgggacccaggttacggctgtgcttggcatgatgacgtcctgcagaaattcctttggctttctacatggagctcagcctccatatcagccagctcaccaggaggtcagagtacttttcaaagatcctcattgtgttgtttcattgtgagaggtttccagccctcgtgagacaccccttggttttacagtcatcacgaacttgtttacgattccgaaaacatacctgccatctgtccatatgtttgttctgcggcttttgatttgctaaaatgctgtagtaactgcaataagttctaccatctggattaattttcacctcagatggaagagtatattttaagataaagataaaatagtaatagtatatcctccttggtagtatccagttctatactttgagctatggtctgtcaataaataatgttatgccagggtcctcaatggagtgcctgaacatctaaggaaggtacagaagtttccctaactaagatagaaaccatggtgagcacaagtttgctatgcatccatgtctccggtctgtctcactatgcacctgacactcattttaacctcaccaggaagtcagttaacttccaaatcagtttattgtaatgcttccaggtaattatatgtggcaatttcaggcagaaatgaataaaaatcttcaccagagaatctaatacagaagaatgcaagaggccctgggcttgttttcataaaagcatcatacaccaggcagttgattctttcagctgttggcactggctcacccagcatgcgggcttcatcccctaagtaagcttcatcatgcatggataggctggcgcctttcctgaggccatatgccgatggatatgcagcactgtgccacacgtccacagagatacaaaatccctgatgggaagaacgaggctggatcaacgggactggcagtttctcattgaggaaatgtgaggtcagtttctatggtgggcaattcaggaaattactcagcagttttgtaattgatggttatggaaaaatgaaccgttgagatgactaatgacttacattccattattccaagtaagaaacggacatcacagttcgctgtaactaaattttcataaccaaatggattactttaaatttcttcctacatcttctcttaataatttttaataacgaatgtgtcttacctatattcccaatatttaaaactgggttgtccagagagtctagagaatttgagaactaggaacagtgaaactcctgtatgttcagcagctcccaaagcaacacaatattccccaggaacactgttctgtcctccagcataattcatgcttgtgtatttcctaatggctccaatagtgaccctccattcccaccaaacatttggcctcccctctctccacttcccctccattcatacattacactctcagctctgtctagggtgtcataaaagccagcggacggaccctcctgatctcctgaacatgaaagccagcactatcatgtgatgggctcctcttggcatggtgaccttcaaaggcacctcatttaaataatcaccttttttttccttctgtaacaaagtgtttctttccattgtgccttcccataagcagtttaacataatttactgtccgaccacagttattaatacacacaaatgccacaacctctttttagcccaagagacctgattaattcttctttggggatgagcacaccctagaaacacatcccattcagataaacacgggcacaccgatgacgtgttcttgagtctacaccattctccgtccaactccatgagcccctgaagaccaagacaggctctttcacacctgtgcaagctccggcccagggacggcctgctgaggaatgggctcagctgggtctgggtgctgggttcatctcttcccctctcctgtcccaaagcaggtccatcaccctgctcaggtctgaacaggagtgtctaggtttttctggccatccgactttttcaatgtatagaagctctcctattacctactgtattcattttatagggcttttataacgaaataccacagatcggatggcttacaatacaaaaccaatttcctcacacttatggaggatgaaagcctaagatcaagctgccagctgggtgggtttcctctgaggtctcgctccctggcatgcagatggcgccttctcactgttctgtggtaacatggccgtccctcggggcctgtgcaccctccctcctgcttcctcttcttataacaacagtcagattgcattagggccccactccaggaatctcactttaacttattcacctctttaaaggacactaatccaagtatgatttcattctgaaggaccaagggttgggacttcagcacatgaatttaggagggacacagtctcccctagcagcctccttcagggatgtcaaataaaaggaataaaaggacactgatgctccagaaggccttgagagtttgcagctgctttgttgtggtgggacgtgggtaggcctgcaccttatctatgatggcagatggaatgactttagttttacccaaccagatgacaccaactatttgactgataagcctggaccctggattttgtctgtattaacctcccatcctctattcagcaagtgagacagcaagacaggggctgtaatttataagctgaaaaaagactcagaggttatcatgataacaccaatgtagtggaaaacatgtatcccctttgggtcagcccatcgactgaggttggaggtcactaggctgtgagatttgggctgtgtaaatatccctggaacaagacagtaaaagtccattgttctttttaggttaatgcaaattgatcttgactctggggcaacagaaatgctgaagaaggtattgactaaactgataaggaaatgctacgtggctaacacctctcctattctcgtcagactggaggagatattaggaacagctgcattcactcgggagaccaccttatttaactcccagtaatctactgtcattctccatgtctcaactggcctctgcatgggccatgcaggtctgttgtaggaaccatgcagtggcctcctaatgcctacctgggctagctccttaacaatcttcatgattggatcatcttcccctcccagggcgggtggtgttgctccagctgtgggactccccatgggttggcagctctactggcatccagtttgccttctgcttggtcacacatatcaccactctaactctccgttggaattccctggccgttgtttggagggtcacgcctaagaagatatccattctcatgtgttctaggatggaagctgtgtatactacacagggtctgggtggcagtcccccaggtcgtatcactagttcaaccggtctgacttccgtggcccttccataaccacctattgccgctatgggcccagagaactggtaggtgttgccagttagagcacattcgttgtctggccaccctgactggctccttggctgtctctcttcctttggtgccattgttcttcatcacagtagggtgcatcccttgcttactcagtttcttcttttctcctaagtcagcaactacctggggcacatgaaatgttggctgccctcccagggggcttaacgtggaaatcagtgcaccatgccattgggtaggcactgaatacataactgtagcttttattttgcagtaaacaattcattgttgggacttcaataattctcagcataattagcatgcctcatctcgactcccagaagatatcctgcaactcttctatagtctgccattgagaacgagctgtgggggcatcttcctcattggacccggcccccttggagcctgcaaccacttaccataaaggtgccatcatagggctggatggtttgtgatgggtgtcattttactcatcttgagtccagagagtataatactctccaccccctatcccatagagaagccaccctgtgatccactctctccccttgtgtctgaatccaattctaagctcccccaattccacagtggtggaattccgcattgtggtgcactgccttctcttaggtgggggaaagttctgtggggctaacttctgctggcacagttggcccacttttatgttggtggtgaccaccacaagtaccatttggctacagactgtgtcctggcattccaaggcttttgtgtctggaaggcatcctttagccagcctgctaaaggttgttccggatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaaggatgtttcccagcacttcctccaagaaggaaatttgtgtgattaccccatatcccggctggccctgtgacttgcttctttcaaacttcttggcctggaaagtgcaggcaccagctgttactgtcacccctgttgtgacactgtacacagcaccagggcaggagcctggggatggggctgaggagagacactagctaggtgaatccattgaaaacttggggacctgctggggttcccactctgagaagcacagatcctagagggtttggaggaggaggaagtcaccatcagtgactcaggagctgctgctctgcaggtcacctgattggcaggtagcagtggcaggtgagtgtgcttcatccctacagggacacgaggcttcgacctgcccctcctcaccaggaaggaaactggctttattcatcccggtttccccagctgtctggtcatcctctcttcctgacctcctgcccagggccctcaggcctgtgatgcatggacaaaggcactttctactccggtcgttgattccccaagccagctccctctagaaaatgcatgatgtcttcctggttctctgtccctggctgaaccagagaggacacacatggatataccaaagtgtcaaagtggaggagaggaatcttggaaagcagtctggagagaggctgcggagaacaggaaacacttgtacagtgttgggtggaatgtgaattagtccaagcactgtggaaagcagtctggagatttgaaaagtatttgaagcagagctgccacttggcccggccatctcatatgtgggtatatgcacaaaagaaaataaatcagtctaccaaaaaatacacccacttacatgttcattgctatgctactcttaatacctaagacataaatccaacctatgtgtccattcatggtgaatttgatcaagaaaatatggtacatgtatacaatggaacactatgcattcacagaaaaagaataaaatcatgtcttttgtggcaacatggatgcagctggaagtcaacattctaagcaagctgatgaagaacgagatgatgagagtcaacgggagatgaagctgacgttttgggtttgcctgtgtgtaaaatggagaaaagaaatcacctgggcacatagactcttaaaatagccaagtctggagccactcatatcccagtttccatttcattaggttttaatctttgtcatttttagcgagttaaatttggttttctttactcttggctaaaataaccacacgtcctgaattagaggcattgcaatcaaaaggtcatatttgaagcttacaagtcccaagtcaggtcaaagttagtgtgggattcagtgtgatagataggagacatggctggatactaagaatgggctcagggttattttacctaagttaggaaaattttttgacatcccttctgttagatttcattggaaacctttgttctaataccatctctgatagattatacctcaataattaagctggaggttatgaattagtaatttaaattaatagtggaagcctccatctagaatatatttctctaccaagtgtaaagttagctcagacggcagaaataactgcactcagcagagcttgtcagtaaggcaaagacatacacaaacacatttattgcaagggtagtgcatgacttggaagtgatccacacacaaaggattctcgcattgtctagaacacgtcaaaatggacaagggaagggattgtaaatgcactcctaagtcctggagacctgactaacataacataggaagaaaaggcaaagaaaaaagtagcataataactaaaatacatctgtaactctatctatctatgtatttatgtttgcaactatatctctatcgaggtacgtatgtatgtatgtatgtagccatctatcatctatctatttaaagcaagcagccctaaaattgtttgtaatactatctaaaaatggaaggaactacaatcactcatataacacagaataatactgtctacagctttctggaaatgttgaaaaaattgtaacccttaaattaaaattttcaaaactttaagaaaatctcggctgggtgtggtggctcacgctgtaataccagcacttcgggaggccaaggcaggaggaccacttgaggtcaggagtgcgagatcatcctggccagcatggcaaaaccccgtctctactaaaaatatgaaaaacttagctgggtgtggtggcacatgcctgtaatatcagcttttgggaggccgaggcaggaatcgcttgaatcagggagacagaggtcacagtgagtcgagatcgcaccaccgcactctagcctgggcaacagagtgagactctgtctcaaacaacaacaacaaaaaaaaaaaaaaaaaaaaaaaaaaaggaaaaggaaaagaaaatcttggacttccttggccaaagtttctccccgtggtgttacggtattatagtcagctcctccagagtatgtccgttattacactattatttggtggctgaaagatcgtacctttagagactttacactcagtgctcaccgctgtcttattgcatgcatgcatgtgttacaaaatattgaaagtgatttctgtattataccaactccattcaccaacagattaaggctactttggtacttcatcttttcaacagtctctcatgtgtctattgcaaataaagtcatgagaaaatactgctcttgaacctcatttcaaggactcttgccaagtacttttagccaaaacaaaggagtgacttttagaatgtcaatacttaggtccatatttataaactttaaactaaaagtaaaatttcagtcaccccatgagattgagtggttccccctcttggccaaggaggcaccaaaaacacctaaaaactgagttcccagctgggcagaacaagagatcagacacacctcattatacccactcccttttgtggttcagagacaacatggaccaacactaacattaaaatggagatcataagactgacagaacagattctccggggcaataagatgccccgttataaacaagacctaaggccatgccaggcaggggttacatccctcaccccaactcttaaagaataaactgttattttcttctgtagcagcaaaataagcactgatcctgagataagcacgatttaaccaactgcagctcatcccctgactaactgaccccccattccacagccataaccccagcttggatgggacaccagattgatttcaggaattttctcctgatcagagaccactgaccatggcctggttctggccatttatggaggctgcgctctgagggtctttgtgcccctgctccagcttttggcacttagggcctaactgtaacacatttaaatgctaagtccccactgctaagtgggtcacatgtgacgtgtatgtttgctcccatattcatgtgtcatgaccacctttatgaacacgcatagcccctcctgtaatccgttgattatgtctgtttagccaacacgttcagcataaagtttctgccccaccgctcctccttgggagtgcctgtctctcgtcttcaccaatggctgtgcttcccagcctgtgaaatggctgtaatcttttataaaaagtaaaggcttattttttaaaatttgtagattgtgtgatttttcatgtaatgcaaccgaggaattaattcataaacccacccagttgtaaggctgctcaagtacgaaggggagacctgcccctccacacctgtgggtattcctcgtcaggtgggatgagagactgagaaaagaaataagacacagaaacaaagtatagagaaacaacagtgggcccagggaaccggcactcagcataccaaggacctgcaccagcactggtctctgagttccctcagtttttattgattattattttcattatttcagcaaaaaggaatgtagtaggagaccagggtgataataaggagaaggtcagcaaaaaacatgtgagcaaaagaatctatgtcgtaattaagttcaagggaaggtactatgcctggacatgcacgtaggccagatttatgtttctctccgcccaaacatctcagcggcataaagaataacaaggcagcattactgcaaatatgtctcgcctcccaccataaggtggtttttctcctatctcaaaattgaacaaatgtacaatcgggttttataccaagacattcagttcccaggggcaggcaggagacagtggccttcctctatctcaactgcaagaggctttcctcttttactaaccctcctcagcacagaccctttacgggagtcaggctgggggacggtcaggtctttctcatcccacgaggccatatctcagactatcacatggggagaaaccttggacaataccccgccttcaagggcagaggtccctgcggctttccacagtgcactgtgcccctggtttattgagagtagacaatgcggatgacctttatcaagtatactgcttgtaaacattttgttaacaaggcacgtcctgcacagccctagatcccttaaaccttgattttatacaacacatgtttttgtgagctccaggttggctcaaagtggctgggtcaaaatggctggggcaaagctacaaattaacaacatctcagcaaagcaattgtttaaagtacaggtctttttcaaaatggagtctcttatgtcttccctttctatatagacacagtgacagtctgatttctctttcttttccctagtgaaggacaccaagctgagcattcccatgtatcctgtaaggcctgagatatattgaagaaggacttgacccgagaccctcagagcaagctgatgatctcacagagtgaagagcttccacccaggacattggtccaagatccctgttcaatttgttcttctctttctttttgttatgtgcttacacttaaaaaaactctattttctgcagacctatttgctgtccacccagagtgaacacttacctcatttttcactcatttgcttaagttgctaagtagaataagtcatcagactctattttgatgcctcattactgatgacaggattaatccttttccttcacttttgtcccccacacatgggaaatttagtagaaaatcatggaagtgtcctcactggatgccagtattaggttcaaattatacaagctccttccccttagtaggaagccccaccattccttcaacaccaaaccatcataaaaaccctgaggcagcttctttcctgctctattgagccagtttggactttattgagaggcctgtgcagccctcagcagacgcctcaataatggagttggtaaatctttccatattcacgtggtgtgtgaatgtggcaccatcagactcgacatccacactaaacattggtgagggtatctcttcctttgcatggggtcacctgcaattggagctgtgagcttgggtcctgacagtgaccaccacgggcactttcttctcttgcactggatactaactccttccgccccagtgtctggcatgcaccgtatcctgcctgctgcttgctggccctttcagtgctgtcatgctgggctgcagtgttgagttaaacaaagtgtcttttatagatttagctgatttacttcagaagcattgataattgacatttaaagacaagattaagcgactgtaggaaactgtcttttacacatgtgagaagatttttcttttattaaaacaaacattttcatttcagagactttggagataagcaaaaaatcatgaattcagataaattcctcaagggaagatgttttatggagaagaagccacagtgctgacgggaaagaagagctcagcctccatctgcacctgcccctgaggctggctcttgtgatcagcgtgtcctgagcacccctggggttagaatcctgtgctcacttcagtgaggtttgtgtctggactcaaactcactttccctctattttttcctccaaattagagaaattgtaagtcatggatcagtgcaggtcagagaacaccaaatagcaggataagcccttaacacacacacacacgacacacacatacccacacacacacaaacactcttaggtgaatcatattcaaattactaaaacatacagacaaatggaaatacatgccagcaattggagacgagtagagggggcataccttgcaatagaatagaaatgaataatatcagcattgctttggttataaccatataagcaataggacaattgatggtatctgtaaagtgttgggaaaaaagtcaacccattattttataaccagtgaaggaaacagttccacatctcacatgacggtataaggagctcgatatatccatgcctccatgaaactggtgagattaattttgaaaaattaacgggtctggaaaggccctgtcaacatacagaaagtgaaggaacatttattcgagataatctacaaaacctcagtaaggtcagacatgatattgatatttgatcaaagattctcttccttccttctatgcccgagctcagcatgatgtaaattccaccacagatggctgcagccaagtagacaggattccttctgcccagctcccagcagagcacactcttccccaggggccaggacattggccctccgaccttgcccacaggtcatgctgctgaggctcagttctagacaagacttactgagaaccagagactcacttcttccacacagccccactcatggatgcaggctctgccctgagtgcagcaccaaggaggaggacattggctgcctggttcccagccctgctcctatggcagagggtccaccccagcaggatctgcatgctggtaaagtggaaagctcctccccatccctccactgagcactcatctcctacattgaggaagaaaaacgctcttaatctccacctgcagaatcttatttaggagctctgtctcaggagtgggggtgaggctgaaatttggtcataaaatagagtcccgaatctggtctcgaaggacctgacttcatttacaacagagtgtggagaattacaaaaacagtggaggctgtggtaaaatgcacttgggaggagatgggtagatgcatgagaggtccaggctaaactgcagggctgctggcctgcaggagagaaccaagaagaaagagagcgggaagagttctcctggggtcagtacaaatgtcaggcactgtttgttcaaaggcgcccatgtttgtttggttcagtctgtagagcaacttagccctcagtgcattgttgaaaatataaacttccaactgcaggtagtggagctcaacatctggtcctggtcagggaagagccagagagagcccagcccaagccagtgacatgtgagggtgacagtgaaatccatgactgtgtctctggggatctttcaggcaggccttctgtcactcagaagaaagtctggagttcacctgtaatggtttgtgtcaaattttcaaagatgttcatgttgtttttagtttctaacacacacacacacacaccacacacacacacacacaatgttaaacatctgaatacgtgtgtgtgtgaacacatgattttaatcctttgtaggacatactcagggatgagagttctaggtcatggattaaggacatgtttaattttataagaaactgtaaacagttctcccagaaactctttcattttgcactagcaatattttagtctctcggggcctggcatgctcactgacactggtactgtcagtatttcttctttatttttcctcattctaaagcctaaagtcgtgtctccttttggtcttgatttgaatttctctactggaaaattacattcatatgctgatgtgtcatctgtacatcttctttgatagaaagtttgcacaaacctttgcctattttataaacagattgcttctttttactgttgagttttgagggttcttattataattacattgttagatgtatgatttgcaaatactttctcccctgaagcttgtccttcagtttcttgatagtcggttgaatagaaaatgttttaaaatttgatgaagttcaactaaaattattttcatttattgcatcacacgttttaattttcaggattgttgatcaactgttaataatttcacatttcaattgtatttttttttattttattcgtatacatttacggggagtgactgcaattttgttacatatatatattgcatagtcgtcttggctttaatgtatccatgatccaaataatgtacatcataccctttaagtaatttctcaccattctcccaacttctgctctcccatgtttctgagtctgcaatgtccatcattcctttctctatgggcctgtgcacatattacttagctcccatttataagtgaaaaagtgtggtgtgtgctgttctacttctcgtttattagacttaaaataatgacccagagttccatccatgtagctgcaaaatacatgattccattccttaatatggctggatagtatttaattgtatatatatgtgactttttaaataaaattatctgttgtaagacacaggttaattccttaggttgatatctatgctactgtgaatagttctgcaggaaaacaaaagtttggttatcattctgatatgatgatttatttttcctttgggtagttacccaatggtggggtcattgaatcaaaggtagttctgcttttatttctttgaaaaatctccacattgttttccatagaggctgtgctcatctacatcctcaccaacaatgactgagacttccctttgcctttgatcgccaccgatgtctgctatttttgcttcttttatagtagccattctgactggtgtaagatacctctttgcagttttaatttgcatatccctgataatcagtgatgtttagcacttgtccagttatatgtgttctttaaaaaaattcctactcgtgtcctttgccaatttttaatgaggttatttgttttttcatagctgttgttgtggtggggttgtttcagttccgtgtaaattctgcctatcagtcccctgccagatgcaatgtgtgcaaatattttttagcattctgcaatttgtctgttcactctgttgctgtgtggaagctctttagtttaactaaattccattcatctatttttgatgttattgcttgtgcttttgaggtttttgtggtaaattatttactaagcccaatgtccagaggagttctcctggtgttttcttcgagtacatttatattttgaagtcctataatcaagccttcagtccattttcttatggttatgtatatgtcgacaggttggtgtccagtttcattcttctgcatatggcagtccaattgtcccagcaacatggcatgaagagcgtggcctcttccccgtgcatatttttgttgactttgtcaaagatcacttgaccatagattgtgtggctcagttctgggttttgtacaacgtacctgagagccttgattctccggggatttcagcactgacctgctcactgctggaactctgttagctcagtaccttttgagtgtagtgacttgttgccatgggatggttttcctaaaattgtagacagttatgtttcatgttgaaacgtgagctaggattttcataagaaaggtattgttgaattttccatttcttttccacattgctcctcagactcactgacgtgggtttctgatgtcaagttgaggcactccctttctaagagctggatttttaattacatgggtatttatgggctccctgtgtggaaataagccttgtctatcacacctaccctacgacatttttagaaatttatttctgcactgttactgtgagacactccgtgatggggacacattccatctgttttattgttttataaaattattttattaacgcacctttctctctacgagaaaagctattatctgaattttcacaattcctcctgctcccttatccccacatttttctccagtgtcatttcctgcagtttaataaaggcatatgttctgctgttttgtattcggccgcttggagtagtatgagcccattaaactggcggccacataccagtgatgcatctggcccaggtaacatgaacatttcatgctgaatgtttgacaaacaggactcagcttctgcttctatgaactattaacaggagtcatgccatttattattaaagaagaaggaggaagacagggctctgagtctaatggggatgggaaatgcaggccctggcaggaaaacgtatctcagctgcactttcctgttctgcagaggtggggagggagcaccaatgagaagcagcctgggtttttgtacaggaggtgccctgggctgtgtctttgtggtctgtgtgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagacccctgtggagaaagcataagaagatgaagcccacaaacaagaaaactgatgtttcacccgtgaaggagtccctgaccacagcactcacatgaagggatggtcagcagcaggagcgtggagcaaagtgtgtccatggtggggcacaggagtcactgagctgggacctgtgctcggctttttcaacccagaggagggtggagctggtggagatttgcattcccctcatctgtgccctactctatgggatggagtcaggtttcaggactcaggagggtgttgcatctgtggtgaggaccagtgatagtaacatgatcagtgtaattcagatggcattaatctaaggctgggcaagtagattctgagtagaagtctttgcagaagtcatgattatgaggtcatgttggtctttttgcaagaactattttatgatagttcttgttgtcagggatatgtgtgtaagaattctccctacacttcctgaatccatttgtcagggttttaacatatgtgactccattttgattcttacaaatttcacaatctcatcctaaaagcactggtggagaaggacagtttatgtagcagccaattaactctacatccacctcccattttaaccagacaaacatatttctttcactacaaatggccacttgcatttccagagaagcctatacacaatacagtggatggtcctgagcaaggagagtgaagaaagtcccttcagcctcttccacatggctgcagtagccacagcctgagccccagctgagctacagggaaagggcttcagcccttgaattgaggtcacggagaccacatttaccttttccagggagcaggaaaatccaaaggaaaagtgagaacgacaactaaaaataaaataaattagaatcaaaagaagcaccagatcagtgttattaatttgcataatttagtgtcaggagaagggtcagacaaaaaacttgtgagggtccccatattctatatgacactgaccatggtctaccatctttaggctgttatcaccatccttaatgactactctaagggagacccactaaggtctctgttctgagtgtgattggagaagactcaacaggtcccagtgagcttctacatgtctccaattttggtgactatggttgagggcttttcatctctgtgtcaatttgtgttttgtccatgtgagagtatgtcctccaaacacaatattttaaaaaaatatttggagatgtcattggtaggcacagaattctaaaattacagaagttccttggagaaactgtcagacggagtttttttcttcttttttcaatgcttgcaggaaagcagtcctaacctttgcactcccctctgtggttgactgatcagtgggtcctgagcgccccctgcagctcattagcccaggtgttcctggaggtttgtgtctcacaccggcctttcctcatgtgcttctcttgcacagtaatgtagtgacgtgtccttggtttgcagattgcccatttgcagaaacagcatcttcttgacattgtctcttgagatgataaatcaaagacaaataaatactctgtcggacaaacaaatcctgagaaaatctattcccagcatattaatcttgccatagacgttttagcagagtttctagatgagcagccatatgatatacatccaatacctgaatgtatccaaaagataaagattgtcaacaatgaaaaaaatgaggtttaaatttagtttttgcatttgtgttttctttattacataaatgtgtaaagcaattataaaaatgtcaatattacatttttatagcttatgtaattacaaactgataaaataaaaaagggatagaaaagaggaattagacatatatagttataatatctctgttctatatataaaggggtaggctgggcacggtggctcatgcctgtaatcccagtactttgggaggccaggtcaggcagatcacaagtcagaagatagagaccatcctggctaacacggtgaaagcctgtctctactaaagatacaaaaaattatccgggcatggtggcaggtgcctgtagtcccagctacttgggaggctgaggcaggagaatggcgagaacccaggaggcagagcttacagtgatctgagattgtcccactgcactccagcctgggcgacagagtgagactccgtctcaaagaaataagaaagagaaagaagtactacatttttgaattagaattcaattatagaaatgtcttattgttatccttatggtaaccaataagatattcatcaataataattaaataataaattaatagaaacaatacatattattgtaaaaagacaaaacaaccattattggacaaaagggtaatatcattaaaaaataattcctcatagttgactaaaaaaaaaaaagacccagcaattatctttctccaagaaaacttcttaacatattcacaaagagaagaaataagatggaaaaatatagaccatgaaaatataaaccaaagaaaacttgaatagctatgttaatttcagacaaaataatcataaaaagaatacctttgcaactcaagtgaaatattgcataaaataataggatcaacttttccaaaatccattttaaaagacctaataaatggatttggaacagaaaatagactaacatgtatagaacatggagaaatcaacactcattgtgattgagaaaacaagcaatgattaaataggtaaagatataagagtcccaaatggcactatcaacctacttgataaatttttatctataaaatattcaactagaaaacttcagaaatacaaactgtcatttaccagaagagaataaaggaacaagacaactgaattcaaactgatggccttgatggaatctggaaacaaacaaatatacgaaagcaacagcaaagagagattctgtcccaaaaaaaagaaaagaagatatccactaaaagggacaaactatgaaatatttaaaatggctcattctgagatatatatgagttaccaaggcccatgacacgaccccaggaattcctgagaacacatgtccaaaatggcttgattacagcttgattttatatactttagtgggtcagaagttacaggcagatattaatcaacacatgtgagctataccatttatgcagtctagaaaggcaggaaagtttatgcacagggttccaggacataggagaattcaaagattttctgattggcaattggttgaaatgtaaggtaatacaatcattacaactgagtgtctggattaagataaggggtcctggagatcatagttcttattatgtagatgaagcctccaggtagcagatttcatacagaataaatcattaggttttgctatttgtcatgtgatgctatactagaatcaagttgtaatttgatgtctttttgctatagaaagtgtttacagcaaaaatatagttttgcccgtcttaagatctttgttgtagtactaatgctggccactggtgccttaattccaaagagaggagcatgtaatgaggcatgtctgacctctcactttcccatcattgctggaacaagttttagaatttactttgaaattcccttggctgagggttgagttcatttagttgcttgaggaagcttagaattttatttttcatttacaatagaaattattggaaaaatgataaataaaataaggtctggtattgaatatatttacacttatcaatgtaaatgtgttaacaccatgtcttatgatgatagaggatattcatcttaggagatacttggagatgggaacacactgtattaactttataatttttttatctataattattctgaatcaaaagtatataaatgtaaaaagtctatcataaaaatacaagtcacaactgataaaataagtttctgaaaattatacaatttcaattacatttatgaacatgtattctggaagaaaatattgaaattaccatcaaaaaatgaccaatgtttatttgtataaaaaacatttgaagcaccaaatactaaaatcaagcaaagagagtgctatttatatagttattttattttctataatatgatttaaaaagtgttattataggcattttataaaccagtagtgagcataattatgttaattttttctcaattttgtgtcaatatcttcttaatttcatatagacatttgttactgcatgtgtcatttccaaaatattcagctattatttttcatattaatatgactcctttgttggccctaggcattgcattttaatatggacatttatcagttcccaaaattaatacttttataatttcttacacctgtctttactggaatctctaaacataaattgtgaagatttcattttaatatggacatttatcagttcccaaaatcaatactttcataatttctttaatctcataatcctgttatctttgtaagctgaggatgtaagtcacctcaggaccctgtgatgattgcattaactgtacaaattgattgtaaaacatgtgtgtttgaacaatatgaaatctgattgtaaaacatgtgtgtttgaacaatatgaaatcagtgcaccttgaaaaagaacagaacaacagcgattttaggaaacaagggaagataaccataaggtctgactgcctgcggggtcgggcagaatagagccatatttttcttcttgcagagagcttataaactgatgtgcaagtagggaagatatcactaaattctttcccagcaaggaatattagtaattaataccctggggaaggaatatgtgatctttgccctgctttttgccccttaaagcatgtgatctttgtgacctactccctgttcgtacaccccctctccttttaaaatccctaataaaaacttgctggtgttgcggctcagggggcatcacggacctatcaatatgtgatgtcacccccggtggcccagctgtaacattcctttctttgtactctttctctttatttctcagaccagccgacacttacagaaaatagaaagaccctacattgaaatattgggggtgggttcccccgataaatcacctgaggtcaggaagtcgagaccagcctgtccaacatggtgaaaccccatctctacaaaagatacaaaaaaagaaaatacaaaaatgaacacatatccaaatatcaaaccaaaacatgaatttatttaatgttattttaattatataattgaatcgaatgtactattttatagtataatgtaatattccaaaatgttgttgctctgtgtgattgtttcactatcctaatgccaattaacaaacatatttaaaggcaaggtttggtagaaatgaaaataaatgccattcttgccaaattaattaatgtacaatggtatttatgtataatcgctgtgttggtttgtttgtcatttatgctgttagtatactttaaaataccaattattaatacatctaataacaagataaacatcactttaaacacattttattacattattggttaaattaacattgtgtttttataaagtcaggataaaatgttcttatttagaaattaggattgttttctaccattgattttccacaaattttcaatacaaattctagatgtttatttgccaacacgcctggatgctagagaacatccagcaatatggacctgaaatcagcccaggatccccagaatgcactcacaatggcagcttgctagagggttgtctgagaattgcaaacacattagggatttgaacttcatcatcaaagcactggtgagcctcagcgctgagcacacagagagcagcaggagctgcagagcccactctgtggtacttaggaaaaggactggatgttgtggggtgatgtctgcaggaccctagaaaagggtgacgatgtcagagagtctgcggatagatgaacatatgcttttttttttgagatggagtttctctctgtcgcccaggctggagttaagtggcattatctcagctcactgcagcctctcaccctgggttcaagtgattctcctgcctcagcctcccgagtagctgggattacaggtgcccgacaccatgcctggctaatttttctatttttagtagagacagggttttgccatgttggccacgctgatctcaaactcgacctcagatgatccacccgtcttggcctcccaaagtgctgggattacaggagtgagccactgcacctgacctacatgagcatattgtaaggtgaactgttatccttctaaacatggttgggttcaatgatcatgaagagaagtgaacagattcaccagacgtggaggagacaaaataaatagatttgttgcttctttgccaggagactgaggaagacaaaaggatttgacagaagggaaggtggagaaacagtgtgaagagcagaagaccagaacccaaccaaagtggaggaactgacccgtgaaagtggtgtttcatctccacaaatggcagacaaaatgaaaggaaacttaacaccgtgacattgttgagttattattagaaaagcattgactgtagtgtgactggcacagcacaagaaacaaaaacccatgcgtggaaccagagtttgaattaggcatacacaatttcttattatcaaaacacattgaattactattgctattattattctaaaaatatgcaaggttaaaagttgaattgaattcctatcctaagttaatgatttgtatgtgaaagaaaccatgggttacaaggaagaaatagtgagagatcgtgggaagacttttgcttgaccagctcaggaatcagctaggtctaaaagcaaacgtcaccttccccaggcacctgatgtggagctgcctcctaagaaaaccgtggtgtcctgagtgattgattccctcgtggttactgaaagccccatggtggccccgagcactccctgttggccctgaacccctggtgtcctcaatgttcttcagtggccatgagtgtctcctggttgtcttgtgggcctttaggtggtcctgttacacctggtggtttctgagaatctcttgttggtcctgagtgtttcctggtggtctggaatgcacccttgtcattctgtggcccctgcttgtgctgagcgccccctggtgtcctgagcgccccctgatgtcctaagtgtctcctggtgtcctgagtgccccctgctggtcttgagcacccctagtgttttgagcaccctgcggcatcctgagcaccttctgctatcctgagtgtctcctagtggttctgagtgtcccctagtggttctgagcaccatttaccacaaagtcccctcttgtcttcctgcagggaagtttgcgtctagactcacccatatgtccctcactgtgtctctcacagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttccaggaatctggggaaaaggtgtgtggattaggtgaaacacacactttttaatcacaatgaaactattttcatggtgttcaatgataaacacatggcataaataatttgtgaaaactcataattttttgagacaaagtgttaacctaaatgcatacaacttcaaaagtatttagctggtcatgaaacacagaataaaatgaaagctgtataaaaatatctaacaatgataaacaggtttgtactaatttcactgcagaaaggggggcatgaatatcagaaacaagtatctttggaaataatttgatgttgtgattgtaaaatataaataagctgcatataagcacggtattctagtcgataaacatattttcaacaagggtcagtttaataattctaacacaatttgtgtattttgaaattgtgcactaagtaaattaatgtcatatgataggaaaggtttcctcatttttcaatgtcagattatggacaggcaaagaaagaagctacggatgtctatgtggatcttggtagtgtgaagaaaccagtatcttcttaggtttaatgtaatatagatacagaagatgagatacataaatactttaattttgaatttttgtgggtaaatggtatatgtgtatatttatggggtacctgactttgatatagcatgaactgcataatactcacattatgatgaatggttcctacatcctttcaagtattaattctttgagttaccaacattccatttatacacttttagttattttacaatctataattatgttattaaggattatacttagtctgttgtgttatcaaatactatgtattatttgttatttctaaccacttttttcatccattgagcatccccaataatccccatctaccatagaccttcccagcctctggtgaccatcctttcactctctatctccacgagttcagttgtcttaatttttaacttccacaaatatatgagaatatgtgaagtttgtctttcggttctgggattatttcaattaatataatgaactccagtttcatccacgttgttgcaaatgaaaaaatctcattctctttatggcataatattaatccatatgctatatgtaccacattttatttatccatcatctgttaatgggcagttaggatgctttcaaattttggctattacgaacagtgctataacaaacatggtagtgcaaacaacattttttttttgtgggagggagtacatgccagcagcaggattgctggattatatgacaacactactattaggtttggaggaaactctaaactgttctccatagtggttttataaacttaagtgcccaccaacaggttatgagtgttctcatttctccatatccttcccagcatttgtttctgtctggctttcggatgaaatcattttaaaatcagatgagatgatatttcactgtagttttgttttgcattgttctgatgatcagtgttacacagcacattttatatgcctgtttgcaatttgaaagtcttattttaagaaataaatatcgcctgctttttattcggattactagatatttttcctatagagttgtctgagatcctggtatattctgatcaatcctttgtcagatgggtagtaatgtctctttctctcacactatgaaagacatgatgtcctcattcacaggtgcattccgggatatacacacagtatcaatggaaaagcagtcattaggcagtgaggcctttgacagcctctacctgatgtctctttttcggagtctgtatctcttaacataacaactggatgttattctgtactcattgctggcatgctgtcactgttttgtgtcaaaaattcatccacattttaatgcaattaaatttgttcctatttagagggtcagtttttgaggtttgtcatgacccagaatgttatttttttttttttaagaaaatgggtctagcaatatcttgcaggctggccttgaaatcctgggcttgggtgatcttcccacattagcatcctcactagttgaaaatacaggcacatggcacagtgtctaactgattattcttaaattatgctatttctcattctctctgctaaaccaagtggatattgctcttgtggagctgtcagcttttcattaattacttacagtaaaaatatattatgtgttttaggataacttcatggtaaaaattattcacagtcaactgcaaacatagtcacacaatttccagagtgctgtatctctgtctttatgccatgcatctttacctataaaaatataacagcctccaccttagtgcacatgaaattattcatatatctcaaagtgatactcctgctttaagagcataaaactgtttgggaatcgtggacttaaatagtctcattatgcctctcccaggaatatccccagaacctctgccatacaagtgagcaggggtgagaataattggagtccttcttggttcttggtcaataacgcatggcatggaaactctgtctcgtaagtgagggtgggaggaggcaggcatccattacatcacagactggaatttagtctccaccatagagatgtgacaccatggcttcaactgagatccgagggagagaaagccacatcttcttttcagatcagctcatgatcatgcttctgtcatcctgagctgcaaatgagagagtaatgcttgtctctcaagcatggtggatcctcactgcccttactgagacttggtaaatggtttagtctgtttcagctgctataacagaactccattaaatgggtggctcagaaatatcataaacattgttttctgaattctcaaggctaggaagttgaagatctagatgcttttgagatcggtgaggaccagcaatttctggtgaggaccggctattatgttcataggggtgtaactgacggacatatccaaacaaaaaattttgcatggatgttcatttatatttccccaaaactgcatacatgttgtattattcctgatcagttgagcaattataaggcttgaataagaaactaaaacctgcgcattcagcacacatatccctgaaattaaagtaaaaaaaaatctgtaaccaaacttacaaataaaggaggtaagaaaatgaggtcagaacagttaacattgagtcctcacgtgaaggccattggtggtaagttacacaatggggctgcagtgagataggctaccaggtgatctaattctgaacccctcaataacagccaaccagcaatctctggcagtgggtatgctagaagttcccagacatgggaaaactctcttactccataaaactgcactggggtcgtctgcagcctctaagttccacaggagcagctcctaccccagacaaatctctgctctttctctggggtcatgagagatgatgcggagaaggtcagtgatatggtttgtttgtgtccccacccaaatttcatcttgaattgtaacttccacaattcccacatgtcatggaaggaacctgatgggaggtgactgaattatgggcatgggtctctcctgagctattcgtgtgatagtgaatgagtttcatgagatctgatggattaaaaaggggagttttccttcatgtgcactcttctctagtctgccaccatgtgagacctgatttccaccttccaccataattgtgaggcctcccaagccatgtggaactgtaagtccaataaacctttcttttatgaattgtccagtcttgggaccagcgtgataacagactaatacagtaaattggtaccagtagagtgagacattgctgaaaagataaccaaaaatatggaagtgactttttaactgggtaacgggcagagattggaagagtttgcagggctcagaaaaagaccagaaaatatgggatagtttgtaacttcctagagacttgttgaattgctttgccaaaaatgctgatagttatatgaacaataaggtctagcttgaggtggtctcagatggagatgaggaactcattgggaactggagcaaattgtggaattttgaacttgagagagatgatttagggtgtctggcagaagaaatttctaagcagcaaagaattcaaaaagcccacttgagtgctattaaaggcattcagttttaaaggggaaacagcataaaagttcagaaaatttacaacctggcaaggcagtagaaaagaaatcttattttctgaggtgaaattcaagccagctgcagaaatttgcataagtaatgaggagccaaatgttaatcctcaagacaatggggaaaatgtctcctgtgaatgtcagaagtcttcacggcagcccctcccatcacaggcctggaggcctaagaggcaaaagtggttttgtggtccaggcccagggtgcccgtgctgtgtgcagcctaaggagttggtgccctgtgtccagccactccagctatggctgaaagacgccaatgtagggctcaggccatggcttcagatggtgcaaaccccaagccttggcagcttccacatggtgtagagccagtgagtacacagaagtcaagaactggtccttgagaacctctgcctgggtatcagaagatgtatgaaaacacctgggtgtccaggcagaagtttgctgcagcagtgggaccctcatggagaaccgctgctaggccagtgagaaaggtaaatatggggtcagagctccaacacagagtccctattggggtattgcatagtgcagctgtgagaagagggccgccatcctccagatcccagtgtggtagatccactgacagcttgcaccatgtgcctggaaaaggcacattcactcaacaccagcctgtgaaagcagccaggagggaggctgtaccctgcaaagccacaggggtggagctgcccaagaccaagggaaaccatctgttgcatcagcatgacctggatttgggaaatggagtcataggggatcattttggagctttaatatttgactgctctgctggattttggacttgcagagggcccctttgttttgggcaatttctgtcatttggatgggtgtgtttatccaatgccagtacccccattgtttctaggaagtaacttgcttttgactttacaggtttataggtggaagggacttgccttgtctcagatgagatgttagactgtggatttttgagttaacgctgaaacaagttgactctgggggactgtaggaaaggcatgattggttttgcaatgtgaggacatgagatttgggaggggccatggggcaaaataatatggtttggctgtgtccccactcaaatcacatcttgaatttaactcccataattcccagtgtcatggtagggacccagtggtaggtcattgaattatggctgcgggtttctccagcactgttcatgtaatactgcatgagtttcacgagatctgatgattgtaaaaagggagatccctgcacaagctctcttctcttgtctgccaccatgtcagatgtgcctttcaccttccaccatgattgtgaggcctttccagtcatgtggaagtgtaagtccaataaaactctttctattgtaaacttccaagtctctggtatgtctttatcagcagcatgaaaacagactaatagtcagacatgatctactcaaggcctctgcacatggagaaaagccagtgaaagtggaaaatgtattttcttgatttattgaaaaatacctatagaaaacacaactgtgtgccaggacatcaagcagaatttaaaaattatgcaattggaataaatgtgaaaattacaatcatttgcagacacacatctgttcatatatctttcaatgaaataaagtaaatgccagtgttctgtgtaaaaatcaacaaagagtgtgttgaccctgagaatacacctctctccctccctttaaaggcaggaaaatgcacatggatcaggtgtcaagctgctgctttctgacgtctatgctatggcccagatcctgtggtccactctaatgaaaggaaggactctttagtgattctgaggcagagtcattgctggagtcacaggggttcccccttgggtaatgttgacttgtagtagactcaaatatgttttacaccttccttgcacagcacagaaacctaagaatgtttcacccaatcctccgtccatctctcctttactcagggacagatttctaccatatgccatcagcttctgcagccacatgtcaccccctgtgcgtttcctgtcaaaagagtggaagtacttcttatgaaaaatgcatgaaagcataatccagtcttggactttccatctcaaaagaccaataataacacatatatttcagcaaaattatttatcctatgattatgactatatttggcaattgttttggcaaaaaacaaaaatcatggtgttggataatgaagatgtaagaagggccaagactgttacaactttttattgatgacctggggcgtagtaggggtaggtgctgacctcaagataagaggactggaacctcattgcaactgtctgagtgtactcacgcaggcctgcgtggggttccaaggcttgcatggcaaagctgtcagtgctgtcatctataattccagcaccacattggagggaacaacatactataaagtacataatgagaactggggtaaggagtgcaattcgcagttttaaaagtaaagatttgaacgcattagtttatggctttgtagcctacaaataatttagaatttcgtccaaactgctgaagaaaaaaaaacaagaacagcaaacaacaggtgtactatatttttaaagcataatttttttctctcttgtccccatttttatttaaaacaaatcaagataggactgatttatttgcaaaataaactttagtcttattattcatggccttattatttgcataaagcacaatacaaataattattgtttacacaggcttttaaaattggctttggtggaactctgttccataaggaatctcagataagacttttttaaagccaagcccagccatgagtttttaccatcaaatacctgtaagtctggtaaattatttttcctctggggtcccaggaaaacatggggttcttgggcctgttagaaagtgacattctttacttaccactggtcaggaaccttgtacaaagactgtgtggacaaggtacaggccagttttcccaaggggctcttattggctgtataagtcaagttcgattgcttaaggtgaagcacgccattacagtcaaagccttggtaaaataaccagtttctccaattgtgtcctgttgcaaaaaaaaaaaaaatcttactgcacttatgaaaaatcatattgccataagttaaggatattcacaaagagtttccaaattctggagaaagtggacagagagaaacaaatattctccaaattttatgtacaggactatactcaattgttgaaagctataaatagctcaaaagaaaagttttcttgggcaacattttaagtgaaaagtcaaaaaagatagtcttctatttgatagttttatctctatactattgtaaccatcttcagagtttttaatcagaaatctgcatgtgagagcacctgttagagtttcatagatggttataaaaccatcacttaaagagaaacaaaacaagtcgataaggtcaaaactcaaagggaggaattgaagccaccactgcaaagctgcaactgaaacagtgaaagagctgtgacctaacctgctccatcttgcctcaaacctccaggttgtccttgtgcattcctgggtgtaggcttacctaacattgggaggaacttagtttagtttatagtttaaaacagagacaataactgccctttcccaaaacaaatctccttcgtcctggggactagactgcctttgggggactaacgaattagccaaaatattagaaattatgttttaagagtcatgcagctggtggctacaaattctaacccttcctagtttgctcctggggataaaatgactattataaagcctaagatcaatgctttagatattttacagactctgcacttgatggatcagctggcatcacccagatcaataaactggctcatccgatcttgtggccccctcctaggaactgactcagcacaagacaccttcagctccctatgattttatctctgacctgatcaatcagtactcatgactcactggctgcccccaacccaccaagctatccttaaaaaatcccattcttgaatgcttggcgagactcatttcagtaacaataaaactctggtttccaataaataaataaataaataaataaataaatgtcatggcaacaatcaattttatgtgtccccttgactcatagagtcatttattcagttacacactaacctaggtgttgtactgatcctataatataagtgttagtaaagcctgccatcatttttttcctaagtcaggaagattgtcctagataacctaggtggggctgattccatcagagcataagagatgatgatgggactccatggaggatgacagtgtaggtcttcccagaaattccaactccattgacctgaaaccctgtaggatttgcctagccagaccctccaattgctgtcacccagagctcacagcacaatagagtgtccatccttagctttccccaaagtcacagatgaaggaggaaattctgtgacagtgtgagaaacagaagatcagctctacatcagtatctcatttgagaaagctaccattatcccctcagtgactaatgtccacttcatttcccaaatgcctccatgcacagaagacagcaggcgggtccaggcaatggtgagtgggaaagtcccctcagcctccccaggtctcacaggagccacagcctgggccacacctgagttccaggtaacaggcctgagccctgagatttagaccacagaaaacacactctctgttttctgggaagggaagaaaagggaactatgagaatgaagtgtagagagaagaaaaattgattagcaagtaagggccagctggatcagttctgagtcagatgtgcacagttttgccagaggagggagaacagctgtaaaaactgtcaggatttaaggaccctcccatgggtgagactccctcttggcccaagtctgaatcccaaacctattctaatcagagatttccacggaggtctctgccctgagcctgactggaaaacactccccaggttccactgggcttcctcaggacactgatcaatgtgaccaaggcagggtcatttctgcccccaaggtgacactcgggcttctgtaggggtgaggatgggtcttcctgttacaaaaaacaaaacaaaacaaacaaacaaaaaacaaatatgtgagggaagtttagcagtcacagacatcaaatgttagtacagaattgcaaatctagagaagttccctcgggtaatttggtaacaaggcagccccagatcaagacaggaaacccagcccttgtagcacctgcacttgcccctggggtcagcacagtgcacagtgtcccaggctttccctggttgtcccaggtaccctgaagggaggtttgtgtctgggctcacactgacttctccttaccgtatctctcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacctgcaaacacagagacatcctggtaagaaactgccacacatatccactgtttcgctcacttatgtccattcacactcaatagctctagttctccataaatcaccttttaaaatagcagcaaggaaaacccacctcagccccaactccatggtgaatcctgtatgttcagtgttgaccaagcagaaacacctgggaatcccggggctgaggctcctctgccagagctgcagggtcagggtttagctggttttcatcagcatggggagggccctatttgcgtgtctcctgctacacagagagctctggggtgggaaccctgaggagatggcagaccccagataaaatgacagggccccgcaggaattgggtgacaattatggtatttggaaaatacactgtcttattatgaaaatgtgttgtgataaacattttgcactattatatttttacatatttgtgtaaattatgttctgtagaagtcaatggtttctccatttacagatgtgaaataaacccacacacggaggaggggctgtgtgtgtctcatgtctgagatgaatgagccctggtagcttggcctgtgctccacatcagtggccccagttactccctgaaccaactccaggtaagaattggacatgcctagtgtgctttgtggaacccacttcctgtattgagaacttgagtgatttttgtggcactctagcattcacctaaaaataaggagagaactagggttcaggaggcaaattctcatatatttctgacttttaatggatattttgtatctttataccaccgcttttggtctaatttttcatttgtttgcttgcaataaattttgtgagtgttaattggcagataatacacttcacgtatttaaagtgtagaattgaaaacatgatgtaagcgtcatcattactgaggtggacaagtgagttcccctcaacattttctcttgttcttctgtatgtttccacatttccccttcctttattctacccttttcccaggtaactactcatcttttgtatattactttagatttttttcatttgaaataaattacataaatggagtaatatagtacatattcttatttgtctggcttattttactcagcataaatacttagatacttttccttgctgttctgtgtaccagaaatatatttattataaatgttgagtagtattccagtgaaaaaatttaccagaatttgtttctctattaggcagctgaaaaatgtttggattcttttattattctggatctcactaaaaaatatgctgctaagcttaaaaatgtacatagatgagaaatatatatatatatacacacatatttatttatttatttatttatttatttatttatttttagagacagagtctcactctgtcacccaggctggagtgcagtggcgcgatctcagctcactacaagctccacctcccgggttcacgccattctcctgcctcagcctcccaagtagctgggactactggtgcgcaccaccacacctggctaattttttgtatttttagtagagacggggtttcaccgtgttagccaagatggtcttgatctcctgacctcgtgatccacccacctcggcctcacaaagtgctgggattacaggcatgagccaccgcgccgggcccatatattcattcttacaacaatagtatcaacaataacagataaacagaaaagatggaagtttgcaaattttacttaatgcttcagataattgagggttgaaaacaaacaaaatatttgaaatctagggagaggcaagttcctgtagagagtaatgaagccagagtatgaaattccctgaggcagaggctgtcatataaaatgtaggctattacaagatgaagaacaaatatacactggattgcttgaagtcgagtgtgttaggcatgttatagtgagaaattctaagggacctcatactggagagttgccctaatctcttgaatcatttacccctgcaaaacatcttcctttcccatagtatctgtctgggagagaatgagctcacacttctgaaatgcatccagacccagttctctgatccccactacaaaactaagatattaccctgcaggagcaagccatgaaaatcagcatcctagggcactggtgcagccccttaagaattgaggtatgaacagaggttcccatcaaagctctattgagaagcagctcccctcactttcttacggaatcagagctttaatctgcaggtcatggcagcagatctggaagttggggacaccaacagagattatgagagctgtgggagggaacaactggggaaaacaagaggaatctgccccaggggaagcagcaagaacacacagaccagcatctcatctggaggagggttgggaacacttggaaagtcagctcacactcaggatcacaatgattttctggaaatatgaccccatgagaggtcagagacaattcctttagtataatgtcttccaccaatttcacaattggcaattaaatataacactttaatccaccttaagaatctgaaagagattctctgtggaatggaatgattgtgtatgaatcatgccatgaaactgtcttcacggtgactggatttgcctgttgattttgacatgatgaccatgatgttgatgacgaagatgacattctcagaaaaataacccaggttcaaagagctaactgcagagtcatatttatgtttgttttacttcgggacagaaagggcatggaagtctaaataacgtaataaatggtctcctgaggtttggatgctgttaagcaaaataagacaacccgaggtggcggtcacagggctccctggactggttcctcgctgcctctgctcctcactgaggctctgtcttgtgtgagttctgagcatctcctgcgggtcctctggtgcccatccagcccagataaaggagggctgggggttctgtttctcaggtgctcagtcctgtgcctggctccagttcaggagctcagcctgtcctgtgtgcagaagcttttagctctcccgtgcaacctcgcctgtacactgagtttcttcacagcaaagtgacagggtcagcttcacagacatcgctgcaggcaattttcagcaaatctaattttagtttgactatgtaattcagcaatcatgttcattgtggtgtaagtgactgacatatccacacacacacaaacaaacacacatgcacacacacacgcacacacacacacccaaactgcatggacattcatttacatttcccccaaactggacacatttgtattattcctgataagttcagaaagttctgaggttttaatcataaactaaacataacattttccataaacaaaattagtaatgaataagatgaaaaaatcgggtcagaaaaatcaagattgagttattacccgcagtctaatggtggtaagttacataatggaactgtgatgagacaggctcccaaggtgctctaattcttaacccctcaagtacagctgaccattaatctccgagagtgaggaagctagaggttccccacacggaaagctctctgactccacaaaacttcgctgagcttctctgcaggctcagaggtgtgcagactcctaccccagattctgcagtcaggcaaatctctgctctttcccaggggacacaagagatagtgtggataagggccagatgtgctctactcaaggtctctgccacatggagaaaaaccagtgaatgtggaaaatgccatcatctcgatccttcgaacaatgcctgtgaaaaactcaactctgtgtcaggacgtcattcaggattaagaaataatgcaactgaaggaaatgtgaaaattacagttgtttgcaggtgcacacttgttcatatattttccaataaaaatacagcaaaagcaggggttctctataaaaattcacaaacagtgtgctgaccctgagaatgcacctccctccctcctcctacaggcagcaaaatgcaggtggatcaggttcccagcagctgctttctgacatctgtggcatggcgtgtgctgaggcccatgtcctgtggtctactctaatgaaaggactgactccacagtgattcctaagaagagccctttcttggagtcacagggatcccctgagaggtagcactgacttacacgagactcagttatcttttgcagcttccttgcatagcacaaaaatataggaaccttcctcccaatcctccctccctctctcctccagtcagggacaagcttccatcatacgccattagcttcccagcctcattccactccctgtgcattttcgctcaaaggggtgaatgtacttcttataaaaatgtagggaaacttcattccatcttggggttttctgctcagaacacgaataatagcacaaatattaggagaaaggggtcccaatttggggaaaatccacagattaaaatgaaaacaagtttcttatgcaagtaaaataatgagactggctacaccagaggtggagcagcagtatgggctgctggttgtccattttatggttatttcttgattatatgttaaacaatggatggattattcatgagtcctccaggcaattcctgaagttgagtgttcctcccctcctttttaaaccacacaaggaaacttcatgatgttgccttgacaactgtaaactgtcttgggggctggaagggagtgttttttagcatgttaatgcattataattagagtataatgaacagtgaggacaaactgaggtcattttagccactgtctcggttttggagggctttgcccagcttctttactgtaagatttatctgcaaggcctttatgacctggatcttgtgcagacctcctatctcatcctgtgactaacttactgcatcaacttactaggaatccagcccagcaggtctcggtcttatttttcctagcccctattcaagatgaagttgttccagttccaaagcctctgacacactcaaaaaatgtagcaaaagtatttataatatgagcatgattatattgccaaatataaaatatcataatgacaacaatcaattttacctgtcgtcttgactagatcacagtctcatctactcaatcacacactagcttaggtgttgctcccatggcatgatacaggtgttaggagagcttgccattatgttttcctaagtcatgaagagtgttctagataaactaggtggggctgattcaatcacagcataacagaagatgatgggactccacggtggatggcagatgcaggtcttcccaggaattccagcctgtctttcctgaggtccagaagtattgaccttaggctgcctagccagaccctacaattactgttacccagagctcacccacaatggactatccatcatcaactctcctcaaagttataggtgagggtccaaactctgtgacagtgtgagaagcacaagttcagctctacatcaatatccaattggagaaaactagtattattcccttaatgactaatgtccacttcatttcccaaatgcctccatgcacagaagacaacaggagtgtccagacaatggtgagtgagaaagtctcctcagcctacccaggtcctgcagacctgagccctgggattttccctgaaaacagaaaacacatcgtttgttctcagggaagagaagaagaaagcgaactgtgagaatcaaacctacagagaagcaaaatggattagcagaaaaagggtcaactgaatcagtctgagtttacaagacgaggggggatagctgtgaaaaccatcaggctttaaggaccccgaccctgggtgagcctgtctcttggctcccatcagagctcaaagcccgttctaatcagaaattcccatggaggtctctgccctgagtctaattggaaaacactctccaggtttccctgggattcctcaggactctcatcctgttgaccacgaaacgattatttctgcccccaaagtgacaccctggcttctgtggagctgaggatatgtactcctgttgcaaaaaaacaaagaaacaaaaaggacaaaaaaagtattgcatttagagacatgaaatgtcagtacagaattgtaaatctggagaagttcctggggaaatttgacgacgaggcagccccagaccgcgacaggaagccagccctcagcagcacctgcacctgccctggagacagcccagtgctcaatgccctgtcgccccctggtggtcccaagggacccctgcagggaggtttgtgtctgggctcacactgacttcccctcactgtgtctctcgcacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacctgcaaacaaagagacaccaaggtcagaaactgccacacaaatccactgtttctcacactcatatccacacacactcaatcttcctagttttccatgaatcaccttctaaaatagcaacaaggaaaacccagctcagccccaattccatggtgagtcctctgtgctcagtgctgatcaccaagtggaaaggccttggagtccagggctaaggctcctctctgagacctgcagggtcagggttgggttggttttcatcagtagagggagggccctatttgcatgtctcctactatataagaagctctagtgggatgctggaggaataggctgtacccatataagaagacggtgctctgcagaagtttgctgacaatgatggtatttggaaaatatgctgtcttatgaaattgtgctgtgataaacactttgccctgatcaccctattacattttttaaaaaatgtgtaaattatgctctgtaggagtcagtattttctccttttacagaagtggaagtaaacccacacatgggggggctctgtatgcatccaggagctcatgtctgggatgagtgaacgctgccatctggccctgtgcttctcgtcactggctctgacatccccctaaaccaactccaggacaaagctgtacgtgcccggtgtggttttcagaagccactttctgtaataagagcatgtgtggttttgctgctgttctgtgtgtcaggcatttatttattataaatcatgggtagtattccagtgaacacatttaccataatttgtttttctattaagcagcttaacaatatttgaattctctgtgactctgggtcttaccaaaaaacctgcaactcagcttcaaaatgtacatagatgaggagtatattttacttactgttttacagcatcaacataacagataaacacaggagatggaattttgccaattttaaaatatactttaaatactggaggttttaagataatcatcaaatccgaaatttagggagagacaagttcttgcagagagtaaaaaggcatgggtatgagttgaactgaggcagagtctggcatataaaaatgtaggctattataagagaaaaaaatacatacatactgaattggtgaagtcaagtgtggtaaatgtgttgtagcgtgaatttctcagggaccacatactgaagagctttcctataccttgaaacctttttcccaaaaatggggacagtcacaaaaatcttttgtcccaatgtgtctgtctgggagagaaaaagagcccacactctgaaatgcattcagacccacctccttaatccccattgcagaactaagaaattactctgcaggagcaagccaccaaagccaggatcttaggggcactggggccatcccttaggaactgagatggaaaaagaggtcttcacctaagttccattgagaagtatctcccctccttcttatttaatcagagccttaatctctaggtcaggtcatcaactctggaagctgataacaccaaaagagaacattggagctgtgggagggaacaactggggaaaacaagaggactccacagcagggaaaacagcaagaacacacagaccaacatctcatctggcagaagttcagaaacaccggcaatgtcacacccagactcagggtcacaatgccttcgtagaaatatagacccatgaaaggtcagaaaatctccctttattctattgccttccaccaatttcacaattgtcagttcaatataatatcttaatccacctgaaggagctgaaagagattctctggaggaaggaacagggtgaagagacaaagccaagcaggaaagaaaaacaaggtatcactggaggatctgaagtctctggtggacacagaagaacagacttcaactatgacgtctactgcaaaagtaaacgtcaaatgtagctctgagaagattcaaacatttccacattaaaggcctggcaaaaataaagtatggtcaaatacaggcagaaaatgcataaaatgaagtaataagccaatatcaactgtccaacctaaaatatctggctatcaacaaagattacatatattaatgagaaataccaaagtcataataaacaaatgatcagaatgagacttctatatgatatggatcttagaactatctaattaaacaagatatataaagtaactataattcatatgtaaaaatctattaaggaaactgtatacataatgaaggactagatagggaactgagagttgaaaatactaagaaaaaatcaaatggaaatgcataagaaatcaaaagcaatgcagtataaacattgagtaagctttgggcacacccttcagtagagctggctcaccttttaaatgaaaccactcacttaaaataccactagaaattttacagagtaaagtgcaaggaaaagagagtgaagaaagtaaacattaatattaaaaagtattgtatatgtacattttaaatctgaaaggagaaattgtagatacagagacagtatttgaaagaaataatggctaagaacgttcccagttttgtgaaagacactgaactacagatcctagaatcacagagaacctcaagcagagtaaacagaaatagacacagacacccacaccacacatccaccatggacagagtggtgcgcaaggaaaaagtcacacatcacacaccacgtacacatttcctcaactttatagtttttacttagttgttttaaaattatttgaatttatggtattaagtagaagtctaaaattaaaatatatcattctatgcataagcctgtctattcttaccatgatcaaatacacggtttggttcaaatgaatgtaactacgttgttaggaaattcacatttcaaagaaaaatggtatttattcctggctctgtgttgaagcatttgtaatgtatgcaaataaaatctgttttaattaaaggattttttaaagttagcacataataactgtatggggtacagtgtgatatttctatgcatgtgtgccatgtggtatgattaaatcagaacaatgaacaaattcatcagcttagacactaacatttctttttgttggtaacatacaaatttctgtcttctggctacttgtaaacataaaatgtgcactatattgttaacagcagtcaccctactgcactgtagatcactggagcacatccctcctatctgcctgtaaattatacgtttgttaacaaacctcttattgtctctcagtctcctcccattcccggcatctcataaccactactctattatttacttctagaagatcaactttttaaaatttccacataacactgagaaaatgctgtatttatttttctgtgtctgtcttgtttcactcaacatgatggtgtccagttccatccatgttgcttctaacagcagaatttcatttttaagactgaacaatattccattgtgtaaatataacacattttatttatccattcatctgttgatggacacatatgttgatttcatatgttagctatggtggatagtgctgcaataaacatgggtgtacatgtatctcttcaatattagttttttactttaatgatttaaatagatacatactcagcagttggattgtgaattatatggtagttctattttttcccatgatggcttcactaatttccatttccaccaatggtctataagagtttccctttctatgaatcctggccagctcctgttttatttatttatttatttagattttctgactctcaagcaaagataaaggatgaaaagacatctcattgtgaatgtgcattttcctgaatattagtgttttctagcgatatatgtatgtatacatactaatatatctatttatctatctatcatctatctgccctttttcttttcttcttttgagaaatatgtattaatgttattcctccattattagccacattattatttgcagttgggttgagtttattttatatgcttgatagtaatcccttgtcatatgaatggttttcaatattgtctatcttctgcaggttccctcttaactcaattgtttccttcactgtgaaggagctaaactctcttgatagaacctggacaggtgggctgaggtcccaatgctgtgggacattggaggggaagagcttgacccaatatcccgaatcaagtgagcttttactcaccatgtggtttctgagtttatggtttgaacagatgcagaagagtttgtcatggcattctgggggataaagaatttgaagagagaatgacataatttattagtcaagtaaataaaaatgtcatgattttccatatgttcttgtgagtgggggtagctcagccagtgtgtgttcatctccagaaaagagaaaattatgtctgctgtgaaaagaatgcatagcttttgacatatgtggttgttatataacaactgagccctggatattaggtcatgttataatgctagtgggaagactcagtagaagaaaaagtgtcatagcaacaaaaatgaagcatcaaagatttaaataaaaagggtttttgaatatcactagtaatgaatatgctgagaaaaatcaattaccataatcagaataataattcgtgaccgcccataggattcatgctgagatgatataaaatttccattaaatggctcatcaccaccctcataaaacggttcagacaagaaattcagaacagtgtgaccttacagccagtggaggccaaacctttgaggagagggagagtctgtgttagaattgtgagaaatacaaacctgaactctgcagagaagcaacagtgatcaaaggcagtgccgagtccacttgagtttagtggtgaacacagtaaagatgggtttctctgccctcattcagtttttgttctcaacactctcttggaagctcagttgtgaacactgggaatcttcctaaaactcaattacagcaaaagcaatttttcactgaagaaagaggtaacaacatgggggtaagtaaatttgggttataaaaattagttattgaaacctcaatgtaagtctctagtaatttaaatcataaaatgttcagcctcatcaatggagtcttcttatcttgtcagagatgagtgtccatgtgggcacgtcgcgcagtcatggaggctggggagatggtctgtccaggctttcctggtccttcagaggagaagtgcagagtcgtctcctctcctgctcccaccagttttcatatctgtgtgtgacccttgagcatgtcatttccatgcgcttgcataataggagtcaaatggggcatgaagctgacatgctggttgtatcagtataattgggcaaagaaactgcctgcatacatgaactcttgcattatccaggcctggagcctctcacatctacactttgcattttattaatgatttcctgtgttgtttagtcagttaaaatgttctttttaactttcttctgaaatagctttacacaataatctagaggcataaagattatgtctcacataataatctagaggcataaagattaaagacaaacttaaaacttattaaagaataactcaccaagttccagttgtggtcatagttagtttgtggtgattgtgagacagggagaagcatggctggaaactatgactgtgctcgtaaatgcttcatgttaacggggaagacactgtacacccaagagatttagacactgccactgagaacctctacctaatattatatgttatgaatcacacctcaataataaaactctaggttaatgacaaaattgctcttactaatataagatttcctttagaacacagtcctctatctgatgtaaaatcagcacagatggcagaagagattgcatttattagaagtgccaatttgttaaactaggaaataaacatgtttcagggcagtgcatgggttcaggatgctttgaaaaaaaaaaaaaaagcatctcacacattctggaaaacccaccaaaatgggcaagttagggaacgtttacaggcactccttttccccagattcctggcagatataaaggtggaagtcaatgcaaaaagaggtaacattgaagctaagaaaactgccataccagatcatatcctcaaaaggtaaagctgctgagtcacagatattatcaaaaatatcaatgctgagccgctgatcttaaataaaaatgagtgaaaatacatagttaccatatttgcttaatttgtgccagatcatttcaaatatgtatttgttgcatttcaactctacaatttatagaaaaattggttaccagattaaataaacagtttgccacttggacacatttatgtaaactttcctcaatttccacacttaacgggatatgaatgtattttatttatcatctatctgtgttctctgtgtcttccaataattccttgacaaaggctacagctctttcagttgattaaaagcttctatattttctgtttttagcctgtgatctgccaggtttttgcatgaaccgagtgaagcacactcatgaaaggaactgttataaaatgattctgtgaggcagggctgatactaaaatatggcattgttataacctcccacagtcttccacataagtttaaaagaatggtattcttacattaaaattatcagttttaagaaacccttgaactcccttgtctacatgtactcctaccagcattgtggcattatggtcctctgtctcaaggatgtatctgttattttcctatgacttggtagctggaaaaaaacacatttggaaatcttacctccagtactagcctttgacctattgtatttggatgaggcagaacactcaaagagattcatgtattatgctcactcctatcaatcagcaaaagattaaagctgccattccagttgtgtttttaacagccttttactatctttagccaggaaaatttatacattggaaaaaatttagagaaaaacttcccttgaaacactggaaggaagcttgttagatatttttgtcaacacagcagtaaaactccacggagtcagtcctagggattatgttttacaactgaataaggaattaaaaattccacacaattggaacgctactccatagaggggattttgacctatttaatttatataccaaccttcacttaaaggcactcttctatggttttccaaacttaagcaaatctctgtaacctgctgaagtctcctcagtgcactttgtctctagatagccacacatgaaaaagcaaattttgtgtatttgtgcatgagtgatctggacacacccttggtattttaactgaatttcatggaaacatgattactgactgtgaactcatatttaatggcattcaaaaatgcatcacccttgtgatgtggtggaaattggtgcctgtgagaaatatgctgatgcttcacttgaacaagttctagacccctcccttgacttcatggttcctcactcggtacagatgtgtctatgagcaaaactcaacactgatacagatatccagcactttctcctgttgagaaaattattttttctctttctaggcctgactctctctctctccctctctctctgtcttgccttttcattatgatttttgccatatcattctgaaacctcccaacagtatgcatcatgaatcatgccaatttcaagcctcaaaaagaaaaaggtgcaaactcataatttcctgaacaaggttagaaaacttcctgcatttccaccagatccattagagactcctaatgagaatcatggtcaaacattattt

SEQ ID NO: 1217 - DNA, 196143 bp, Homo sapiens
cagaaatgcagcaaaacccttcagagttaaagcaggagagaggttgtgaggactcacctgaggagacggtgaccagggttccctggccccagtagtcaaagtagtcacattgtgggaggccccattaaggggtgcacaaaaacctgactctccgactgtcccgggccggccgtggcagccagccccgtgtcccaaggtcattttgtccccagcacaagcatgactctgcccaccctttgccccagcagcagagtcccagttcccaaagaaaggccttctgctgaacgtggtcccaaacagccggagaaggagccccggagggccccacatggcccagcgcagaccaaggagcccccggacattatctcccagctccaggacagaggacgctgggcccagagaaaggaggcagaaggaaagccatcttacctgaagagacggtgaccattgtcccttggccccagatatcaaaagcatcacacagggacacagtccctgttcctgcccagacacaaacctgtgcccgtgcaggacactcgaatgggtcacatggcccaagcacagagcagaggcagccggcgtccctgtccccagccacacagacccccgggctgagacccaggcagggaggggtgacgttcccagggagacggtggccgggctgccctggccccagtgctccaagcacttgtagccacactaaagcgcaggcctggtccccggcacatgaacagccagcgcccagccccagcccaggctctgcccacaacttctccttcccgtccctgccctcggcctgcttgctacctgtggagggtccctgacggggctgaagcccagcggggtccctgcctgtccttgggggctccagctggccccagggctaagtgacagcagggctctggcatgcagcccatggcggagaccccagggatggcagctggtgtggcctcaggccagacccaggccggctgcagaccccagatacctggcctggtgcctggacagagaagactgggagggggctgcagtgggactcacctgaggagacagtgaccagggtgccacggccccagagatcgaagtaccagtagcacagcctctgccctcctgcttctcccatacaaaaacacaccctccgccctcctgccgacctcctttgctgagcacctgtccccaagtctgaagccaaagcccttgcctggcccagtacacctggctccccgctatccccagacagcagactcacctgaggagacggtgaccagggtgccctggccccagtgctggaagtattcagccacggtgagtcagccctgagccaggggctacagaaacccacagcccggggtcccgggggagcatggtttttgtagagctgccaatcactgtgtccccagttagcacagtggttctcagctcagccaaaaccctgcggctggtagggggcctgtggggctgggggctgatgtggctgcggtctccagggcgggtcgggtccaggggcccccagcacctttgccagtgctctcccttccgctgttagccccaaaacacgtgggagaccccagccctcaaccctgccagtcactctggagtcttgtgccaataatttgctgctgttaagaatcattagagtgctgaaggctgccaagtgtgtttttccttttcttttgtaaattagagcagatctgaagctgggtctgtcacgccacctctcatccacttgctttctgacttgttttcccagcagcagagaggcccgggtggcggtggccaggggagcctcctcgcctggagggccacggcccccgccagggctcctcgctggcctgcaggggcaggaagcctttcctgctctgatcccgtctgtggggcccggcgggggttgcctggttggttccacctgttcaccgtcgtcccactgaacgggaggcctcagtgggtggcactgggcctcactcaccacggcgccctggcgtgggctccctgcgtgtccaccagtgctgggtcccttctctgagcctcagctggtcctcagtgagtctcagctcttcccatggtgggtgccagggaaggtgcaaggtggtctaaggagagcccctccccaggcctgcactggctgccttccgccgagtctgggtgaggggctttgcacgcaccactggccagacgcgggctgggtggggccctcagggaggctgaggcctgcggccaggtgtgagcatgggggtgtgcctggtgagggcctctgctggggatgaactgatgggcacagggtgtctgggggcaggggaggtgccctgcgggcttgctggggagggtctgtgtcggggcagagttccagggagaggaacaggcaaggcaaaggctgggaggctgggacctgtcgttggaggacacaggtggtttcctgaggctgggtggaaagggggcctgtgtgccttgaaggggccgaagggtgctgggggcttgcttaggcgctgcccaagaaggccccctcaggcaccgtgcgggcagggatgaggggtctgggagggaagcctggatgtggggagagggttggggctcctgtaggggtgtggacagaatggcggcggtttgtggagtttcctacagggttccaggcaggacgggggaccctgaggtgctgtctgggacagtggatctctctagacatggttgaacagctgccagcatggggatggagtcttaggctgggaatggtgagagaacccacctccagccacgaggggccgagaacccatttgtttaggggtggttgggccctgatggcctgggaggcacctgtgagggggtgaggtgggggagtgaggaagagggtggtctggcgctgggggagtggctctctggcctgaggaccctctgcccccacctgccacaagcacacaccagggaaagcacacgagtgtcacaggcgtggcggctggatcctacaatgggtggccagggcagggcccacaggccaggtcgagttggtcccccagcctctcccaacagctggcatctcctggggcacctgtcccccctgagggtcacttagcctggatggtacctcctggcctggctgccctgagcagggctgggagctgagctgggagctgcggccccgagggcagtggagagggcgctccgctcacgtggcccacacactgtttaggacgcggcctttagagtctgctccgctcccgtggcccacgcactgtttaggacgcggcctttagagcctgctccgctcacgtggcccacgcgctgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcattgttcaggacgcggcctttcgatcccgcggaagacagtccttgagcaggagcagctccccagctgagacagggccctggatgtccaagccagagggaaaggcccggggtcaggaacaagggagggtctgggcctagaagcaggggggcaacacctactccaggcactgagcctctggaccgtgcggtcctggagaaggagaagccagaggcgacccctggcagggatggcaggcctcacgggaggacagggcactgccgcaggtctccacgccttccaggcctatggtgcagcttggcgagctggccaggctccaggttggtgaggggctggctctgggctggctctgggctggctctgtcatgggccagatggctagaacacagggtatcactgtgaggaatgacgctgtctgtcactcccaggttagggagaacgcgttgtttcccttatacccgaggctccgcttctgatggtctctgctgtaggagacgtggtttccacgcttccaccactgctcctgccggcctgggtactctgctctggggggatggcccttctgggcaaagacacagcagaaagagtcttgctgcttcatttcccaggtcagaagcaacgcaggagcacaccactgcttcagctgataatcgacagagtctccctcctctaacacccaattccttccctaagaggactgggagagtgaggagaaggtctgaggagaatcatcttccctggcatggagcttggcattttgtcccaaaggaaacagtggaatttgcttggggtgaattttgcccaagttttttcagcttttcccattttgtgtgtaatactcatatgctatatagagttgggttttatcttgtggtccaatttgaaagtctcttccttttaataggcaagttaaggccattgatgtttgttgttttcatagatctgtttggcttcaatcttatcttagtagtttatattttctatttttatgcttccaaaaagttttccatcttaagttttcttgttctttgctatcttctatgtgtagtggctacctttataactttccaaaatattctttgttcttctttggacaatgtactttagttctttactatatacgagtatgaaattacctggtttcctcttccttttcccctccatctctagcatcatgtgattgtaatcagtaatattattttcttagaatttgtttgtactgtctaatatgcccaatttggttttactgaagtcctttggctgagagttatttggagtgaggcagtaattcagaagtgctctctatctcatattctgtgttttgatcattgtaaaatgtccactttgtcaggcagacaccatttcacctctgttgaggccacatggtcccccacagtcatttctatcttagtctcgcagttaaggacacttaatatttacttttggttcttggccctgggttctccaagcaccttttgatggctggtggtcttcctctagtagtttcatcatgagattatggattatagaatgtttggaactccttttcagcagccttttttcttcaagaacagttggctgtatatagactctggactatccactacttctttcccccttaaggaccctacaggttttgtcctaccatttactgatcttgaatgtggctggtgagaaatctaggactggtcatcatcccccttatagatgattgtgtgtgtgtttttttctttttttttttggatttagaattttttcaaatttgtgcccaaattagttctttctaaaattaattaccaaaagtaatagaacagaaagcatacttaaatctataatttcaaaaactctatcctgaaataaaacaagattgcccacgtattggtagggtgactgagagaaccagagaaaattggcttagaatggtggctcctgagatgcactggactccattctttcttaggtactcggattatgtggatgtcgtctcttctttgcctgtcttccatatctgtcacctctttttatatattttattttacagaatttttatgggtacatagaagatgtatatatttatggggtacattggatgttttgatctaggcgtgcaatgtgaaataatcacatcatggaaaatggggtatccatcctcttaagcattatcctttgtgttagaaacaatccaattatacacctttcattattaaaaatatacaactaaattactgactatagccaccttgctgtgctatcaagtagtaagtcttattcattctttctatttttttgtacccgttaaccactgccacctttccctatccccccaccaccgttctcagcatctggtaaccatccttttactctttatgaacatgggtgcaattgttttgatttttagatctcattaataagtaagaacattgtaatgtttgtctttctgtgcctggcttatttcacttcacataatgatctccagttccatccatgttgttgcaaatgactcaatctcattcctttttattattgaataatactccattgtgtatatgcaccacattttctttatacattcaactgctgatggacacttaggttgcttccaaatcttggctgttgtgaacagggctgcaacaaacatgggagtgcagatacctcttcatatactgacttcctttcttttgtagtatatacacagcagtgggattgctggatcctatggtagctttctttcagttttttgaggaactttcatgctgctctccacagtggttgtactaatttacaatcccagcaacagtgtatgggggctcccttttccccacatccttgccagcatttgttattgcctgtcttctggatatcagccattttaactggggtgagatgatagcacattttagttttagttttgattgattgtgtttctgtgataatccatgatgttgagcaccgttccatgtcggtttgccatctgtatgtcttattttaagaaatgtctattctaacatttttcccatttttaaatcagattattagatttttttttctatagcactgtttgagctccttatatattctgcatatattctggtttttaatcccttgccagatgggtatttttcaaatattttctcccattctgtgggttgtctcttcattttgttggttgtttcccttactgtgcagaagctttttaacttgatgtgatcccatttgtccatttttgctttggttgtctgtgcttgtgggatattactcaagaaatctttgcctggactgatgtcttggagagtttccgccaaggttgtcttgcagtggtttcatagtatgaggtcttagatttaagtccttaaacaattttgatttgatttttgtatatagtgagagagagaggggtctagtttcactgttatgtatatggatatccagttttccccacattatttattgaagagatatcattatctattccccagagtatgttcttggcaactttgtcaaaaatgaatttgctgtaggtgtgtggatttatttctgggtttttaaattttgttctgtttgtctctgtgtctgtttttatgctagtaccacgctgttttggttactatctatagctctgtagtagaatttgaagacaggcaatgtcattcctacagtttcgttctttttgcttaggagagctttggctattctgggtctttgtggttccacgtaaattttaggattttttttttctatttctgtgaatgatgtcattggtattttgataaggattgcattgaatctgtagattgctttggatagtatggacattataacaacactgattcttctaatccatgaacatgcaattgctttccattttttggtgtactcttcaatttctttcatcagtgttttatagttttcattacagaaatcttttacctctttggttaattcctaggtgtttatttgtggttattgtaaatagggttactttttaatttctttttcacattggtcattgttggcatatagaaatgctactgatttttgtatgttgattttgtatcctgcagctttactgaatttgttcgtcagttctaataactttttttggtggagtctttagttagctctaaatagaagatcataccatatgcaaatgaggataatttgacttattcctttccaatttggatgccttttatatctttctcttgtctgatcgctccagctaggacttccagtactatgttgaataacagtgatgaaagtgggcatctttgtcatgttccagatcgtagaggaaaggctctcagtttttcctcatttagtatcatactgtgggactgtcatatatggctttattatgttgaggtaagtttcttttgtacctagtatagaagagaatttttattatgaaggaatgttgaattttatcaaatgctttttcagtatcaattaaatgatcaaatggtttttgttgttcattctgttgatatgatgtatcacattgattgatttgcatatgttgaaccatctttgcatcccaagttagataaattccacttggtcatgatgagtgaactttctaatgtgtagttgaatttggtttgctagtattttgttgaggatttttgtgtcaatattcatcagacatattggcctgtagttttctttttttcatgtgtctttgtctagttttggtgtcaggttaatactggcctcgtataatgagttttgaagtattccttccacctctattttttggaatagtttgagtaggattggtattagttctactttaaatgtttggtagaattcagcagtgaagccgtcgggtcctgggcttctctttactgggaggctttttattacggctttgatctcattacttgttatcagtctgttcaggttttgaatttcttcttggtttaatcttgggaggttgtatgtgtctaggaatttctgcatttcttctagattttccaatttattggcatatagttgcttatagtagccactaatgatcctttgaatttctgtggtgtaagttgtaatgtcacctttttcatctctgattttatttatttggatcttctgtctttttttcttagtctggctaaaggtttgtcaattttgtttaacttttcaagaaaacaacctgttgttttattgatcttttgtattgttttcttcatttcaattttacttatttctgctctgacctttactgttttcttctactaattttggatttgatttcctcttgcttttctagttctttaagatgcattgttaggtttttttattgaagtttttcttcttttttaatgtaagcatttgtagctgtaaacttccctcttagtactgcttttgctgtatcccataggttttggtattttctgtttccatgatcattcgttccaagaaaaatttcagtttccttcttaattgcttcattgacccactcagcattcattaatttccatatatttatatagtttccaaaattcctcttgttattgatttctagttttagtccattgtggtcacagaagatgcttgatattatttcaatgtatttgaatattttaaaacttgttttgtgacccaacatatggtctatccttgagaatgatctatgtgctgaggaaaagaatgtgtgttctgcagctgttggatgaaatgttctgtaaatatctgttagatccatttggtcgatagtgcagattaagtccaatatttctttgttgattttctatctggaggatctgttcaatgttgaaagtgggatgttgaaatctccagctattattgcattggagtctatttctctctttagctctagtaaatacttgctttatatatctgggtgctccagcattgggtgcatatatatttacaattgttatatcctcttgctgaattgacctgtttatcattagtgaccttgtctcttcttatagtttttgtcttgaaatctattttgcctgatataagtgtagctactcctgctctttctttggtttccattggcgtggagtatctttttccatccctttgttttcagtctatgtgtgtctttatagataaagtgtgtttcttgtggacaacagatcaatgggtcttgttttttctttaattgattcagccactctatgtcttttgattggagagtttagtccatttacattcaatggtattattgataagtaaggacttactcctgccatattgctatttgcttttggtcttctctctcttcattcttttctccgtcttccttttagtgaaggtgattttctctgatgacgtaatttagcttcttgctttttgttttttgtgtatctgttgtattgcttttggtttgacgttaccatgaggcttgcaaatagtatcttatgacccattattttaaactgatgacaacttaacactgtttgcataaacagacaagtaaaaagaaaactaataaagactctatgccttaacttcatccctccaccttttaactttttgttatgatttatatcttattgtactatgtcttgaaaagttgtagttattatttttcattgcttcatcatttagtttttctactcaagataaggctagcctgaccaacatggtgaaacaccgtctctactaaaatacaaaattagctggacatggtagcacatgcctgtaatcccagctacttgggaggctgaggcaggagaattgcttgaacccaggaggtggaagttgcagtgagctgagattgtgccattgcactccagcctgggctggagcaaaactccgtctaaaaacaaaaacaaacaaacaaacaaacaaacaaacaaacaaaaggagtttacacaccacagttacagtgttataatattctgtgtttttctgtgtacttactattaccggtgagttttgtgccttcagatgatttcttattgttcactaacgtgtttctttctgattgaagtactccctttagcatttcttaaaagacaggtctggtgttcatgaaatccctcaacatttgtctggaaacaaattatttctccttcatgtttgaaggataatttcaccagctatactgttcgagggtaaaagttttttccttcagcactttaaatccattatgacactctctcctggcatataaagtcttcactgaaaagtctgctgccagacatattggagctccatagtattttattcatttcttttcttttgctgcttttaggatctttttaaagtccttgtcatatgggagtttgagtattgaatgccttgaggtagtcttctttgcattaaatctccttggtgtactacatccttcttgcatttggatattgatatctttctctaggtttgggaagttttctgttattatccctttgaataaactctccatccctctttctctacctcctctttaaggctaataattcttagatttggccttttgaggctattttctagatcctgtagatatgcttcattgttatttattcttttctcttttgtctccttttatcgtgcttttccaaatagcctgttttcaagctcactaattctttcttctacttgatatatgaggctatgaaaatactctgatgcatttttcagtatgccaattgcatttttcagctccataatttctgcttaattctttttaattgcttcaatctctgttaaatttatcggataggattctgaattccttcactgtgttatcttgaatttctttgagtttcctcaacaaagctactttgaattctctgaaagataacatacctctatttctccgagactggtccctggtgccttatttagttcactggttgaggccatgttttcctggatggtgttgctgctaggagatgttcttcagtgcctgggcattgaagagtgaggtgtttattgcagtctgggcttgtttttttgcagtctgggcttgtttgtttgctcctgtccttgggaagtcttcccacatattcaaaaggacttgggtgttgtgatcttagctatatctgctttagggggactccaagcccaaaagactcatagaggtactgctttgataatcttggccaagatctagaataattctctggattaccaggcagagactcttgttctcatcccttactttctcccaaacaaatggagtctctctctgtctgttctgagcctcctggagatgggggtggagtgacacaagcacccccactaccactatggacaccaccactatgacagtgctgggtcagacctgaagtcagcacaacactgggtcttgctcaaggcctgctgtaaccactccctggctaccgcctatgtttgttgcaagctgtggggctctgcaatgagcaggtggcaaagccagccaggcatgttctttcccttcagggtggcgaggtcccccaggccccaggcaggttcagatcacttgtctttagttccgtaaaattttatttctgctctgtttcatctcattcatttttctccccatgtcctatttgtgtcttccacgggatctgtttttcctctcgctctttctacttgccatgatgaagggtttttaaaaaatttattttgtaactttggccaaaccatattttatctcctcctgttcatttttgattctcttctcttgtatttgagctccatgattttccttcataaatccaatcccttcattattttctatccatggaggattacttggctgaaattctcatctcatcgtttggaaatattgttctggtgaatattttttatacactttgctgccgtttctaaaaagtcgatactgttccagttcaagtttattactcattttcatgaattaagctctactgggcctgctctttgtagctgtttccatggagtcgggagaagaggagcctgtgaagctttgcagcccaaaggctttctcgttttctgctgtggcaaggacaaatgcatgcagcagattgacttagggtgtgactggctggccagcgccgtccgcatctcgaactcacctggacacatggacaccaggcgtccgctggcaactctctttattctgggtcctgtgctggtcattgcatttgcaggataaagctgccctctcagaagaggtcctcatgtttagaaagtgtattttagctgtgctggtcattgcatgtgcaggataaaacttctgccctctcagaagaggtccttgtgtttagaaagcgtatttcagctgcctctgggccctcacaccccgtcatgtattcacttccttccatgtgacctctgcccaatgtcaactgtttttggcatcttcacatatattttggattctgtgggttttatctgttttcctaatttcaccaaaaaatgaaagtttccattaaaaaaaaaactgtacattgtgatccagcgatcccactactgggtatttatccaaaggacatgatgtcagtatgttgaagagacatctgcagccccatgtttactgcagcaccatccacaacagctaagaaatggaatcaacctaaatgtccatagttgatgcatggataaagcaaatgaggtccattgacacaatggaatactctttagactttaaaaagaatgaaaccctgtcatttgcaacaacggatggatctggaggacagtgtgttaactaaaataagccaggcatagaaagcaaatactgtatgatctcattcatctgtggaatcttaaaaagctgaactcatacgtagagtatagagtggtagttaccagggccaggggccggggtgggggatgctggtgaaaggatgcacagcctgagctggcaggagggtgaggtcgggagcttggctatgcatgacggtgaccacagttgacaacaatgtattgcattcttaaaaaatactaagagagtggattttaagcattctcgccacaaaagatgacaagtatgtgaagtaatgcgtgttaaattagctcgacgttgctgttccacgatgtatacatattttaaagcatcatgttgtacacaataaatatatacggcttcatttgtcaattaaaacatgaattaaaaaagaaaaaacgtctacattttgctttttcgcaaccatggggaaggcagggggacctgtttggtgagggaggaagggtcagatgtgcatgaacgtgcgtgtcacccgtgcccggggttgttgtggctccatccactgcctcaccctctccgacctggtttgtcccctggaggcaacctgctcggcgcctctctctgggccagctgcatcagtggctgctgatgtaaggaccccaagtcctgggcagccttgcagccgacctgggccttggcccactctgctgcctcgttcccttgaggggtggctccagggaccgcgcctcaaccacccccagagctgcctgcagcaaaccttggtcagcaggctggggtgactgccctgcgcagggccctagcctcccagaccccctgagctctgtgcaagccattgtaaagagtccctcagcaagctccctttgccgtgtgctctctctttctatcttttcttaccatgttgggaggcagcaaacactttctccagctttcttttcatcagctccacgggcctctgggctctgctcctcagcctcacttccagtggttgccctagagcttcgaacacgctcctagcattgcacagccatcctcgtgagaacacaggctggagtggccatggtaggcactgagagacgctggcacccccgccatgcccctggccccccagcgcccgctccaggcttcactgtgctgtccgtgccttcctgtctggagctttgcatctttatcttcgtgtgatgaaatttgtctttattcaaaaaaacaaatttctttgtcttttttttttgagatggaatcttgctctgtcgccaggctggagtgcagtggtgtgatctcggctcactgcaacctccgccttccgggttcacgcatttctcctgtctcagcctcctgagtggctgggattacaggcatgcaccaccatgcctggctaatctttgtatttttagtagagatgggttttcatcatgttggccaggctggtctcgaactccagacctcaggtgatctgcccgcctcggcctcccaaagggctgggattacaggtgggagccaccatgtccagcctatttgtcaatattctttattgtacatattgaataaataaaataaaaatgaaccatcttacacataaaaatagacatacacatttatgaatatgcttaaacaccacgtaggatttacgcagtgagagaagcactcaagcgaccacattccctgagtgtgtccgggtagaaaatatgccagctttgttgggcataacattcttgaatcatattttctttccaacagacttttacaggcattgataagtttttgtgtttttcaagaaatccgaggcgacactgacttccccttcataagggattgttgtgcatggggctcatgttacttacactgaagtctggtaactttaatgaaatccatttgctatggaatggtctggatttctggctgcctctcacttccttagtctcggctagtggagcggttggagctggaagcctcacccccaccctgcctgcccctgggcaccctgaggctgccttcagtgaggaggtgaccccaagctcagggctgacctgcacctggcactctgcggcatgaacccaatgcaggaagaaaggaaggagggaggagggagggaacacaggggcgctgggagcgaatgcagacagaaatggcagtgacccgagtgccaggccgtcctggtttggggttgaactgtgtggaaacagctccctggcttgtgtgtaagtggttgggggagggcatggaggtctggggcaggaaggggtggcaggaaggcagctcccggccctgagggtctgaagcttatcttcttcctgtgagctggcagtgggcggctccctggggctgtgccctggactggtggtctggtggtgcccaggcctcccagggagagcagggcagctggggctggaggagccctggggcccagtacccacacctgtgcccagcgccgtcaggggggaccggggcacgaggctcctttgcccaggaagggaagcgagtgagtgagacctggagcccccaccctatgggcggctccaaccctcctggagggggactgggcagggggtaggtgtgtgtgtgcaggtgtggggggatgaggaggggtgggctccagcctctgggaatcctgccaagggcttgggcactgcagggttgctggacccgggctgcctggtgtggccatggtggctgcatccccagagccgggatggaggcgcagtggggaccggcgccagggagttgcctagtggtggctgcatggaggacctgccctgcatgatgcccctatcttggggggcatggggtccacatgagaggaaggggcacaagccccctcctgggggtcttcctgagaccacctcagtcagggctctgtgcttggtgactttccagaaggtcctccctgcacagaccccaaagtctgtgttgccccagggcaggaaagaaaaatctgtgtcctggtcgaggttgggccccacaatggtggcccctaaacctgagtctgctccaaagcacccgcccctcagcaggccctgagtgagggacagagacagcggtggggtctttgatccaggtggacacgggggtggatcccagtgggaagtcaccagggccagggtcccccagggtattggggtgtctgtgttcctggtgtcggctctggatttggggtttgtgcctgtgctgcctgggggtgatgttgggaggtgcagatggccccggcccccatcctcaccatccaatggggacactgtggagctccaagtgctgggggtcatgagggctgggaaggtcgtatgttcgggcggctggtcccttctctggctgggcctccagcagtggccgggagacagttttggacatagcttttctcacagtggtagtagctcccactatacccaccgtgactcggggctgttcagaatccacccaggcgccctgagctctggggcctcctgggtaggggctgggctgctgggtggggtctcctgtggaggctctggcggctgtggctcaccttaggtgtggggtgaggactggcagccccagctagcggcacccacagagcctgaagcctgcacacattctgcctgggtgtgtggggtgggtccgggcccctctgggcaggatggcctcaatggggagggggctgggattcccgcctggctcctcctcggggtagaggggacccatctcctggccctggatcccctcaggctgcccctgttttctcaggaacactgaacagggcagggcgccctggaggggagacatctgttggcttgagtgtcaggtgtggcctcagatcctaaatgtgtcctgcctgctctctctgccttcggctgacttgggatggggtttctgtcctgcccagtgtcattgtggtagccgctgctatacccgactgtgacacagacagcttcagaaacctcctggtttgtttgggggccttccattgctgggctcagcgcgcctcttggacttggctgccctggacaggggtgtccctcaacactggttctggggggcctgtccctctgtctggtgtctggaatgggggtccgagacagaggccagctgcctcacagccagcaggggccggagacaggtgttccacccatggtgggtcctggtgggcctggatggagctgaggtctgtgccagtattggggtccccatatcttgctccttcatggctctgagctccccctggcaggacttcttcggggtgctgggtctgtcctctgtgggaggggctgcccccaggcccagcactgcagtggagggctcactgaggggcttttgtatctggcctgagccgctgtggaggtattccactgtgagagggtcccgcacagattctcccatcctgcttctcctcccagagcctggaggggatgggatccgggggtcccaaaggtggatcctagacccaggggaggggggcctcttcactgacctccccttcctccattcctccctccccaaagctgccctggcggcccccctgcaccccagcctctgtctgcactggctctgccggctctggtgtaggtgggactcaggatggtgtggacgacgtgtggccagggtggagaggaggtgggcgggtcggtggatgagagggatgggctcatccaagatggagcacctgcagggccctgagccctcccccacaccgtccctggtccttccccgcagcctgccacggtgggagccccaggcagggtggaccataccctctaggaggctggcacttccctgggttcacgaagacggagcctcctgcccggtggtgcagtggccccgcttcctccttcagcccttcctgatggcttcctggggattctggattcccatggagtgatgagaggagagcagaggggaggaggggcagggctgggtcctgggtaagggggtgctcgggctggggtccctggagagaagttctgggttcctgggggacaattaggcaggcgtcctttctgtccacaccccaagggtcccggcaggagccaggtgggggaaccataaggagagggcctgtgtcctgtccccccaactcctctagacagggtgggggctgaggggtcctccccagggcagggccaggcagtgactctggtgttgggttgttggtcgtcatgggctgacctggggagtgggggttgcagagtagaaaggggcggacttaggtagggcatggcacagtcatccctgtgttcaggccatttcctgtcctgggtgcctgcactgaacctcggcaaggacaggggtggcctcccagcctacagcctgcctgggatctgctctggccctagaactggggacagaagccatcctggaggtcagcagcctcctaggacagcaggaggagaccaggccagcccctagcaggggaggcagtggggattttggtagggtctgcgttgagagccagtacccagtagtcacagagcaagatgccccagcaatatgtcctatctgcagccgtctgcccaccctgtcttagccagggcaagagagggtactgtgcccctggcaggcccagcctttggccttccttggagggatgagggcctgggaagccgagctgttggtggcgctgggaagaggttcccaggacagggggatggagcttaatcaagcggcctggttggggttgggtccttctgcaggctggccactcagtgatggggatctccgggtggtccctgcacctagtgccaggatacacacagtgctctgggcccactgtctgggctccccgccttgtttccagggggctgggtggttctccaaggctcagtttccccactgtggagtggatgctgctggagggatgaggatcgtagagcacagcttggcagcttctgtgcctgctgcccctggggacctgggctgtgggacggggcaggcttccccatcagggctgggcctgccgggagcccagcaccctcacacgcccacactgggggctccgtggctctgtgactccatggctctgtggtgctgcctgcacctctcagggcgggaagctgcctttccctgccagcctttgatttctatctcagtcatccctgccctggagcacagacctcccactgagggaaccctccccacagagggccagagggcagacagcagccttgagagccccaggagaagcaggtgagctggaggcctggggctgcgtggcaggggtctgtctacttggcctggttgctgctatgggcggcaccactgtggtaattgtagccatctctaccacggcctggcaccccctgacaataaccacacctggaactggaggcggggctgtcaggaggagcttcccagggaacagggagggtccagacagctgtgccaggggcccccagtgctagagagcctgggggctgctcagggaccagacatgcactgtgtccccctggagaggcctctgcagcctcctgggctctgggacgggtctctggtcagcaggaggctgggtgctccccggcatgtgctctcctgccctcactggtgagctcctatgtggcccagtgtgggcccagctccagcgtccactcctgtcggcctggccgagggtcccggcagaactgggcatggctccttcttaggggcctcgaggactctctctacagctgtacctggggctgggggctccacaagtggtctttgccaggtggggacgacaatggcaggtgtttctacatgggcaggtgaggggaactgtctgcggcctggccctgcggaacacagcggcctctcagaggagggtgtgtgggagtcctgcctgttgggagcctggcggatgctgccctcttgattccagccaggatgggaatccaggcaattggcaggaggtactggaatgaggctggtgtctacagtaattcccggccccaggaattggcttttggaactggggcatctctcggaacagggtctggtgcagctggcagtgaagggaccagggcacctgtggtcatgagtgaagtcacctcagagccctctgaagcccctgtttggcagcacacggtgtgcagggcaccagcccatcggctaagatggcccgggtgtccctagaggccgagggtctgggcagaaaccctcgggcctggctcttgtgctcctggagagctccgagccgagaagtgtgcataaaccctgcgagtccagtcagtttttgctgctggtttcatcactgtgggagttaccaccgtagtcacacagcaggagggcccttcacaaaaagcccctgagtgtggccagaggcctttcccacacaggccctggtccaggcgtctggggcccccattgacagtggtgctgcgtcctggggatctcaggcctttctgaatcttccccgcctgccattgagggcaggtgggtctgactcaccctcccgggctcctgtcccctccaggagggggctgaggtgatatctggcaggagggtgtgcaggagtcaggcctcctggagtttgagccctggggcaggtgcaaggtggggataccttttaggggtctgggaagggctgggctgtccccatgggccatcgcgtgttctgggggccgtcctgatccagatgtgcgttcccgctgtgatgctgctgaggactgtcctggaagagggtgggagagaagagaaaccctggaagagggtttctctcactggggagagaaacagggatttctggaaggttcgttgtctctgactgtgtgaggtgagtcctctgttggcttccctggtgaggtctggaaatgagcaggactcaggacagccaggcaggatgagcgactcccagctccggctgtccctgggaatgtcttggaaatgacccaggagaggctcaggtgtcagggccaggcaggccagggaccacaggggcagtgacagtgcacagggccagccccgccctcctgctgcccctactctgacatggggggctcgcagggttcacacacgtggcccagcgttcagggaggggcttccgggactgctgggtggacggcagcagatggtgctatggggccggccctgtctccatctggtttggcgttgggagggcagcagcgatgcagaccccttggagccagatctggatgacctgtagggtgaccttggccatctgtttcatggtctctggggctggtgggctggagcccatcatggtcacttgtgggcctgtccattgtttctgctgccccgtgtgtttgggtcatgggctgcactgctgtggtagccaccatacccatggcgccgtgtcctcgatcaaaatcctaacacggcatgcagcggtcccccgcagggagggctgtggtgggaggctcccaggcatgagtttttgatggactctgtgacactgtggtagtaataaccactactatcatagtaataccacagtgacacagacctcacttcaaacctaccgccaggcctggggaaacccgggatgtccagggctgacctgaggaggcagcagggccccgaggggaggctgtgggcccagcgctctcaggtctactgcagggacactcgggtctgtccctcgcttaggtggacactgtccatgcccacctgtgtcctgaggcttcacctcaggctgacatctgtccctactgtccctacccaccccatggccatgtcctttcgggttcataaattgcccccaaatcacacaggcatcattctggggctttttatattccctgggccaccaggtgcctccacccagaaaggtcagatgtgggagagttgcagagtcattccccaaccctggatgagtccctacagcctcagtgctactcaggctccagcaagacctggagcaggtgcaggtgaggcccgaggccaggtgaggtccaggtcaggtgaagcccaggccaggtgaggtccaggtcaggtgaagcccaggccaggtgaagcccaggccaggtgaagcccaggccaggtgaggtccaggtcaggtgaggcccaggccaggtgaggtccaggtcaggtgaagcccaggccaggtgaagcccaggccaggtgaggcccgaggccaggtgaggtccaggtcaggtgaagcccaggccaggtgaagcccaggccaggtgaggtccaggtcaggtgaggcccaggccaggtgaggtccaggtcaggggaggctgaggtggatgtgtgaggcttctgcagttttctctgggtgctcaccctgcctggtgtccctgcccctcctctcagcacccactctgtgcctgcaaggtggtggcccgtgcgcaggtggtggtggctgcggaggtgctgggctctgcctccctgtgcatgggtgtgcatcttgggttctggccagggagtgtggctgagttgcttctctctggaatgcactgactgtaccttccttggggatatacagctctgtgcctgctccacatcaggccccaggagctgccagcaggtgcctgcctgccctgccacacagtgagcctgcagcctgtccggggatgcccagggaggtgattgccaccacacatcaggccttttctctttaaagtcatttctttggggatacatcatcgatgtctcatatactgaatgtatgtctgtatcattgtgcaattgcctgtgtcatcgcttatttatccaacctgggttaatgtctttgctattatgaacagtgctggactgagaattttctaaacacaggtgtgtgcattttcctcttcttgcgatttagaagtttaactgctgttttcaaggtactgtaatgtatttgttctgttcttgttaggagacttgccgactctgtgtgtctcagctcataccctcttccttccccagtagaagtaaccaccactgtgtttatgtgatcatcgttttcttgattttccttatagtttttccaggggaaagtttatcccttaagaagatagttcattttgccgggtgtaaattttatttagaagaaatcacattaaaagtattttttgggctttcctctgttactccaattactcagcattgtcatgaactcaaccgcaaagccgcctgtagctctctactgttgtcctctggctgtcctagtttgcatttcatgaacctgccatcgtttatttgtctgttgtccttcagatggacgtttgctttgtccagccccatagtttggggctatgacaaacagctgttctgcacatctttgcccatgaggttctcaggaagggctctagggctggcattgcctgagggttctgctttgtcacaggcagttcctgccagtgcttttcagagtgtctgtgcccagcagcaatgcctgaaggtgcccactgaactttgccttggcatcaggcactttctgtgtgcttgcttctgtgctgctccacattctggaggatttattcagatctgtgctgcaaatgcatttcactgattctctctttagctgtgtctacatcagctgttaagcatcccatgatgcagcattgtgggcacagggcaaactttcaaaagatgacagtgtaggatagcggctgctcctccttccctgtgctcttcccacactgtcctcctgggctcactcccagccattgatcctgaataccagtttatggaactctctgcacaggaaagcagaaacagcaaaaggccctgctcaggctctgcccacatcccctcttgcacacctgccaaagctctttccttggggcctgtgcaagcttcccagctgcttctcattttctgtttactctgctcactggctggtggggtgatgtcttggggagagtctggtgcattttgggcattgatggacacccctaggccatacttcccagatgctcccccagcccctcagccccaggagtgggtgcgtttgcagtagggctttaggaatggggttgtgtcactgtgggaatagcagtcaccaccacaatatgctcacagtgacacgaacccccacaaaatcctcctgtccctacaggagactggtgtcaccgagtctcctcttgctggctctggcctggctctcctgctgagactgtgcattccagcgggttgttgtctgaaactgagcctgtctcagagaggactctgagcccagtgctgtacagggggctcctcctttgtcctgggggagttgcgtggaccctgtttttggtcaagggaagcatttgatggtgaaggagacctcccctcctctctttctcaggagccccctctgatgctgttgcctagtgtttcttggggctggtgctgggggctcagcagtgtctgccctgttccaggtgggactgtgggtctgttctgtttccacggggtgttctggggccgccagtgaggggctcgggatgttagcggctggtctctgtccctatggtctgggctccggttcactgctcccctgccctccaggtcggtcactgactcggttactatccagcgacctccgtggctgttcagtggtggctgcaggtctcttcccaggagaggcctgcgagagggctgggctgtctgggagccctgcattctcccgtgatgttgctgcctggatccctcatctttagagggagtgcggagcctccctgcaggtgcaggcagtgagagacacaggcggacgtgtgtcaaggcactggaggccgatttctttcagtgccttctgcctgtggaagagctgagctccctgcttctgcgcacaggaggctcccgtgtaaccaggcagtgagggcaagggcctgcatggggaagacttgggtgagcctttgtcctggaaataccagggccgggtctgagagggaggggagcgtggtcagagtgtccaggaggaaggtgatggcatgggcagtgtgtgggtgggagtgtagggtcagtgccatggctcaagggctccaggagaggaagaactcaagttgtgggcaggaggggttagggggtgggcacaggtaggaaaacctgaggctcttgtggcagaagagcggagggcctgcaggtgcagagttggcctgggaggggtgtttagagggagggacaggggtctggttgcagatcagggtgaggactgcagggtcacgtacccagggttgtttgggtgggcggcaagtgcagcaggtagaaaaggcccgaggcagggtggggtctccccagcgtgtgggctgcagggaggggctgcacagggtgttccccagaaggagggagcacagaggcactgggagggaatggagagggaaatggcagtgaccctagtgccaggcagtcccggtttggggttgatctgtgtgggaacagctccctggcctgtgtgtaagtggtggcaggaaggcaggtcccgccctggggtctggagcttatcttcttcctgtgagctgtgtgtgggtggctcctgtgggctgtgccctggacctgtggtctggtggagcccaggcttcccaggaacggcagtgctgtctgggctggagcagccttagatgccaggtcagggtggccctggggccactgcctccagctgtgtctagtgctgcagggatctcggcatgaggccccttctcccaggaggggaggcacgtgagtgagaccctaagtccataccccatggtggcttggccctcctgcagagggtctgggcagtggtaggtggctgtgtgcagatggggggtggggggtggggaggttagcccctcccagacgcaccctgctctgctccagagtgtgggcttgcccactgcagggtggctgggcctgggcttcctggtgtgcttgtggtggctgcattcccagagcagggactgaggtccagtggggtcccgggaggagtctgaagggggctccatggaggacctgccttggatggcacccctatcttggggaggacctggggtccagctgggaggaagtggagtggccacctcctgagggccttcttggggccacctcggcctgggggctctgtgattggccaccagccagtagttcttccctgcccagaccccaaagtctgtgctgccccaggaaaggaaggaagggtcagtggcctcatcaaagttggggcccacagtggtgtcccctaagaccgagtctgctcccaagcgctcgccctgcaggaggccctgagtgagggacagagacagggcagggcctttggtcctggtagactctggggcggattccagtggggagttatcacggttggggtcccccagagtgttggggtgtctctgctcctggagttggctctggatgtggggtttgtgtctgtgctgcctggggttgatattgggaggtgccggtgatccctgtctttctgaggacacttgtcagaagggtcaactccagccagaggcaatggggccacagcagaaggatgtgatcaagtccctgccgcaaaccaccggagcccccagcccttgtcctcattatccaacggggacaccgtggggctctgggtgctgggggtcatgggaaccggcaggacatgggttcagggcggctgctcccctctctggcggggcctccgactgctgccaggagtcagttttggacacagtttttctcacggtggtcgttccagttatacccactgtgactcggggctgttcagaatccgaccaggcgccctgagctctggggcctcctgggtgggggcaggggctgggctgctgggcggggaatgcttagggggctctggaggctggggctcgctttaggtgtggggtgagcactgggggccccagctagcggaacacccacagagactggggcctgcacacattccgccccggtgtgtggggtgggcccaggcccgtctgggcaggtcagcctcaatggggacggtgctcgggtcctgcctggctcctccttggggtagaggggacctatcgcctggccctggaccccctcaggccgcccctattcttgaagaaacgcaggacggtggagggtgccctggaggggagacgtctgctgccctgggtgtcaggtgcggcctcagatcctaaacgtgtcctccctgctctctctgcttccgctgacttgggacggggtttctggcctggcgagtgtcactgtggtaccagccactgctataccccactgtgatacagacagcttcagaaacctcctcgtctgtttgggagccttcccttgctggggtcagtgccccttggtcttgtctgccttgacggatcatccctcaaccctggttttggggggcctgcccctctgtctggtgtctggagtggggtccgagacagaggccagccacctcacaacccggagacaggtgttcctcccatggtgggtcccggtgggcctggatggagctgaggtctgtgcctgtatcggggaccccatatcctgctctttcatggctctgagctccccctggcaggacttcttcggggtgctgggtctgtcctctgtgggaggggctgctacccaggcccaggactgcagtggagggctcactgaggggcttttgggtctggcctgagccgctgtggggatattccactgtgagagggtcccgcacagattctcccatcctgcttctcctcccagagccaggaggggatgggagccgggggtcccagaggaggatcctggacccaggggaagggggcctcttcactgacctcccctccctccatccttccctccccgaagctgccctggcagcccccctgcaccccagcctttgtctgcactggctttgctggctctggtgtaggtaggactcaggatggtgtggaagacgtgcagccagggtggagaggaggtgggcgggacggtgggtgaagggggaggctcaccgaagatggaggagcacccgcagggccctgagccctcccccacaccgtccctggtccttccccgcagcctgccacggtgggagccccaggcagggtggaccataccctctaggaggctggcacttccctgggttcacgaagacggagcctgctgcccggtggtgcacggccccgcttcctccttcagcccttcctgatggcttcctggggataccggattcccatggggtgatgagaggagagcagaggggaggaggggcagggctgggtcctgggtaagggggtgctcgggctggggtccctggagagaagttctgtgttcctgggggccaattaggcaggtgtcctttctgtccacaccccaagggtcccggccggaggcaggtgggggaaccataaggagagggcctgtgtcctgtccccccaagtcctctagacagggtgggggctgaggggtccgccccagggccgggccaggcagtgactctgatgtggggccctggttttcgtggactggcctggggggtgcggggtacagagcaggagggggctgactctgttgggggatggcgcagtcatccctgtgttaaggccatttcctaccttggtcacctccagtgaaccctgggaaggagggggtggcctcccagtctgcagccggcctgggatctgctctcgccctggaactggggacggagacattctggaggtcagcagcctcctaggactgcaggagatcaggccagcccctagcaggggaggctgtggggattttggtgaggactgcgttgtttgggagccagtgccccactaggcacagtgacagacaccccagcagtatgtactgtcccccgccaggctgcccaccctatcttagccgcggcatgtgaggttgcccatccattggccttccgtgcagacatgaggccctgggatgttgagaacagacctcccactgagagaaccctccccacagagggcagagtacagacaacagtgaccttgagagccccaggagaagcaggtgagctggaggcctggggctgcacagcaggggcctgtctacttggcctggttgctgctatgggcagcaccactgtggtaaccatagctgtatccaccacagtctgacaccccctgacaataaccacacctggaactggaggcggggctgtcaggaggagcttcccagggaacagggagggtccagacagctgtgccaggggcccccaggactggggacatggggggctgctcagggaccagacatgcacagtgtccccctggagaggcctctgcagcctcctgggctctggggcaggcctctggtcagcaggaggctgggtgctccccggcatgtgctctcctgccctcactggtgagctcctatgtggcccagtgtgggcccagctccagtgtccactcctgtcggcctggccgagggtcccggcagaactgcgcatggctccttcttagatccctcggggagtctctctacagctgtacctggggctgggggctccacgagtggtcttttccaggtggggacgacaatggcaggtgtttctctagtggcaggtgaggggaactgtccagggcctggccctgcggaacacagcggcctctcagaggagggtgtgcgggagtcctgcctgttgggagcctggcggatgctgccctcttgattccagccaggatgtgaatccaggcaattggcaggaggtgctggaacgaggctggtgtctacagcaattctgggccccaggaattggctgttggaactggggcagctgttgggacagggttcggtgtagctggcggggaaggggccagggcacctgtggtcatgagtgaagtcacctcagagccctctgaagcccctgtttggagcagatggcatgtggggcaccagcccatccgctgtgatggccagggtgtccctagaggccgagggtctggctacaaaccctcagacctgactcttctggtcctggagagctccaagctgagaagtgtgcatggtccctgggtgtccggccagtttttgctgctagtttcatcactgtggtagtcaccgtagtcacacagtaggaggggccttcacaaaaagcccctgagtgtgcccagcggcctttcccacgcaggccctggtccaggcgtctggggcccccattgacagtggtgctgcgtcctggggatctcaggcctttctgaatcttccccgcctgccatcgagggcaggtgggtctgactcaccctcccgggctcctgtcccctccaggagggggctgaggtgatgtctggctggagggtatgcgggagtcaagcctcctggatttttagccctggggcaggtgcagggggtgggacgccttttaggggtctgggaaggcctgggttgtggggctgtccccatgggccatcttgtgttctgggggccgtcctgatccagatgtgggtgcctgctgtgatgcgaccgaggaatgtcctggaagaaggtgcccactggggagtgagacagggatttctggaaggttctttgtctctgactgtgtgaggtgagtcctctgttggcttccctggtgaggtctggaaacaagcaggactcaggacggccgggcaggatgagcgacgcccagctccggctgtccccgggaatgtcttctatcttagaaatgactcagaagaggctcaggtgtcagggccaggcaggcgagggaccatgggtgcagggacagtgcacagggccagccccgcccttctgctgcccctactctgacatggggtgctctcagggttcacacatgtggctcagccatgagggaggggcttctgggaccactgggtggacagcaggagatggtaatgtggggttggccttgtccccatctgggctggtgttagagggcagcagcgatgcagaccccacggagccatgtctggctgaactgtggggtgaccttggccatctgtttcatggtctccggggctggcgggctggagcccagcatggtcactcacaggcctgtccattgtgcctgctgccctgtgtgtttgggtcatgggctgcactgctgtggtagccaccatacccatggcgctgtgtcctcgatcaaaattgtaacatggcacgcggcggtcccctgcggggagggctgtggcatgggtttctgatggaccgtgtgatgctgtgggtataacgataactcccccaaacgtaatcataataccacagtgacacagacctcacttcaaacctaccgccaggcctggggaaacccgggatgtccagggctgacctgaggaggcagcagggcaccgaggggaggctgtgggcccagcgctctcaggtctactgcaggaacactcgggtctgtccctcgcttatgtggatagtgtccgcgtccaactgtgtcctgaggctccacctcaggctggcatctgtccctatgtccctacccaccccatggccatgtcctttcgggttcataaattgcccccaaatcacgcaggcaccattctggggctttttatattcccagggccaccagatgcctccacccagaaaggtcagatgtgggagagttccagagtcattccccaaccctggatgagcttctgcagcctcagtgctactcaggttccagcaagacctggagcaggtgcaggtgaggccggaggccaggtgaggtccaggtcaggtgaagcccaggccaggtgaggtccaggtcaggtgaggcccaggccaggtgaggtccagaccaggtgaggtccaggtcaggggaggctgaggtggatgtgtgaggcttctgcagttttctctgggtgctcaccctgcctggtgtccctgcccctcctctcagcacccactctgtgcctgcaaggtggtggcccgtgcacaggtggtggtggctgtggaggagctgggctctgcctccctgtgcgtgggcgtccctctcgggctctgcctgggcagtgtggctgagctgcttctctctggaattcactgactgtgccatccttgggggtatacagccctgcgcttgctccacatcaggccccaggagctgccagcatgtaccagcctgccctgccacacagtgtgcctgcaacctgtccggggatcccagggaggtgagtgccaccacacatcaggccttttctctttaaagtcatttctttggggatacatcatcgatgtctcatgtactaaatgtatgtctgtatcattgtgcaattgcctgtgtcatcatttatttatccaacctgggttaatgtctttgctattatgaatagtgctggactgagaattttctaaacacagctgtgtgcattttcctcttcttgcgatttagaagtttaactgctgtattcaaggtactgtaatgtattcgttctgtgcttgcttggagacttgccgactctgtgtgtctcagctcataccctcttccttccccagtagaagtaaccacaactgtgtttatgtgatcatcgttttcttaattttccttgtagtttttccaggggaaagtttatcccttaagaagacagttcattttgcctggtgtaaattttatttagaagaaatcacattaaaagtattttttgggctttcctctgttactccaattactcagcattgtcatgaactcaaccgcaaagccgcctgtagccctctactgttgtcccctggctgtctgggtttgcattgcatgaacctaccattgcttatttgactgttcttcagatggacgtttgctctgttctcagtttgagtctatgataatcagctgttctgcacatctttccccatgacgctctcagggagggctctggggctggcattgcctgagggttctgctttgtcgcagggagatcctgccagggcttttcagagtgtctgtgcccagcagcaatgcctgaaggtgcccactgaactttgtccttgcatcaggcactttctgtgtgtttgcttctgtactgctccacattctggagagtttattcagatctatgctgcaaattcatctcactgattctctctttagctgtgtctacatcagctcttaagcatcccatgatgcaatagtgtggtcacaaggcaaacttttgaaagatgacagtgtaggatagcggctgctcctccttccctgtgctcttcccacagactgccctcctgggctcattcccagccactgatcttgaacaccagtttatggaactctctgcacaggaaagcagaaacagcaaaaggccctgctcaggctctgcctgcatcccctcttgcacacctgccaaagctctttccttggggcctgtgcaagcttcccagagcctctcattttctgtttaccctgctcgctggctggtggggtggtgtttggcggggagtctggtgcattttggacattgatagacacccctggaccctacttcccagacgctcccccagcccctcagccccaggagtgggtgtgtttgcagtagggctttgggaatgggtctgtgtcactgtgggagtagcagctaccaccactacaatatcctcacagtgacacgagcccccacaaaatcctcctgtccctactggtgtcaccgaggtcccttttgctggctttggtctgttctcctgctgagactgtgcattccagcgggttgttgtctgaaactcagggtgtctcagagaggactctgagcccagtgctgtatagggggctcctcctttgtcctgggggagttgcgtggaccctgtttttggtcaagggaagcatttgatggtgaaggagatctcccctcctctctttctcgggagccccctctgatactgttgcctggtgtttcttggggctggtgctgggggctcagcagtctctgccctgttccaggtggggctgtgggtgtgttatgtttcctaggtgtgttatggggccaccattgaggagctcgggatgtcagcggctggtctctgtccctatggtatgggctccggctcactgctcccctgccctccaggtcggtcattgactcagttactatccagcagcctctgtggctgtttggtggtggctgcaggtctcttcccaggagaggcctgtgagaggactgggatgtctgggagccctgcattctcccgtgatgctgctgcctggatcccttgtctttagagggagtgcggagcctccctgcaggtgcgggcagtgagagacacgggcggacgtgtgtcaaggtgctggaggccgatttctttcagtgccttctgcctgtggaagggctgagctccctgcttctgtgcacaggaggctcccgtgtaaccgggaagtgagggcaagagcccaggcctgcctgggaaagacttgggtgagcctttgtcctggaaataccagggcttggcctgagagggggcggggtcggagtggccaggaggaaggtgagggcatgggctgtgggtggtgggagggcagggtcaatgccatggctcaggggctccaggagaagaagagttagagttgtgggcaggaggaggtagggtgtgggcacaggggggagaaactgaggctctagcgacagaagaggacagggcctgcaggtgcagggttggcctgggaggggtgtctggagtgatacacaggggtctgggtggagaccagggtagggactgcagggacaggaccccagagttttctgggtgggcagtaagagcagcagggttggaagggccccaggcagggttgggtctccccagggtgtgggctgcagggactggctgcacaggctgttcccccgaaggaggaaccagggaggacagaggcgctgggagcaaatggagaaggaaatggcagccacctgagtgccaggcggtcctggtttggggttgttctgtgtgggaacagcttcctggcctgtgtgtaagtggacgggggagggcgcccaggtctggggcaggaagcagtagcaggaaggcaggttctggccctgggggtctggagcttatcttcttcctgtgagctgtgtgtgggtggctcctgcacccggtgccctggacctgtggtctggtggagcccaggcctcccagggacagcagggcagcctgggctgcaggaacctcagggaccaggtcagggtggccctcgggcctctgcctccacttgcgacaggcgctgctgtgggaacctgggcttgaggccccttcactcatgatgggagccacgtgagtgagaccctaagtccataccccatgtggggctctgaccctcctgcagagccgctgggcaggggtgggtggggtgtgcaggtgggggtggggtggggagctcagcccctcccagaggcaccctgctctgctccagagtgtgtgcttgggcactgcagggtggctgggcctgggctgcctggtgtgcttgtggtggcttcatccccagagctgggactgaggcccagtggggtccagggaggagtctgaatggggctccaaggagcacctgccttggatggcacccttatcttggggaggacatggggtccagctgggaggaaggggagtggccacctcctggaggtctttccagggccacctcagcctgtggcctctgtgcttggcgacctgccagaagttcctcctggcccagaccccaaagtctgtgctgccccaggaaaggaaggaaaggtctgcgtcctggtcaaggtcggggtcacactggtgtcccctaagcccaagtctgctcccaaggcctcgcccggcagcaggtcctgagtgagggacagaggcagaggcagggtctttggtcctggtggactctacggcgaattccagtgggaagtcatcagggtcggggtcccccagggtattggggtgtctctgctcctggagttggctctggatgtggggtttgtgcctgtgctgcctggggttgatgttgggaggcgccggtgatgcctgtctctctgaggacacttgtcagaagggtcaactccagccaggggcactggagccacggcagaaggatgcgatcaagcccctgccccgacccgccggaatccccagctcttgtcctcccatccagtggggacactgtggggctccgcgtgctgggggtcatgggagccggcaggacatgggatcagagtggctgctgccctctctggcggggcctccggcagtggccactggacagtttttgacgtagctattctgacagtggtggttccggttatacccgctgtgactcggggctgttcggaatccgacggggcgccctgagctctggggcctcctgggtgggggctgggcttgtgggcggggtctcctgcgggggctccggaggctgtggctcattttaggtgtggggtgagcactgtgagccccagctagcggaacacccacagagaccgaggcctgcacacattccgccccggtgtgtggggtgggcccaggactctctgggcaggtcagcctcaatggggagagtgctcgggacctgcctaactcctccttggtgtacaggggacccatctcctcaccctagaccccccctcaggccgcccctgatcttgcagaaatgcaggacagggtggggtgccctggaggggagacgtctgctggcctgggtgtcaggtgcagtctcagatcctaaacgtgtcctccctgctctctctgcttccgctgacttggaatggggtttctggctgggtgagtgtcactgtggtaccagctgctgctataccccactgtgacacagacaccttcagaaacctcctggtctgtttgggggccttcccttgctgggctcaacaccccttggttttgtctggctttgacggggcgtccctcaaccctggttctggggggcctgcgcctctgtctggtgtctggaataggggtccaagtcaggggtcagctgcctcccgacctgcagaggctggagacagacgttcctctcagggtgtgggctgggtggtcctggatggagctgacatctgtgcctgtatcgggggccccatatcttgctccttcatggctcttagctccccctggcaggacctcctcagggtgctgggtctgtcctgtctgggtggggctgccacccaggcccagttgttggacgtcgtgggctggcctggggggtgcagggtgcagagcaggaaggggcgcactctggtggggcatgtcccggtcatccctgtgctcatgccatttcctgccttgggcacctgcattcaaccccggcaagggcaggggtggcctcccagcctacagcctgcctgggatctgctctcgccctggaactggggacggagccatcctggaggtcagcagcctcctaggacagcaggattccaggccagcccctagcgggaggcagtggggattttggcagggtctgcgtttttgtcagagctaccacccagaagtgacagtgagaaatgccccagcaatatgtcccgtccacagccgtctgcccaccctgtcttagccagggctagggagggtgctgtgtttctggcaggcccagcccttgaccttccttgcagggatgaggccctgagaagctgagctgctggtggtactggaagaggtctccagggcagggggttgagcattaatcgagtggcctgggtggggccggatcctcctgtaggctggtcactcagggtttggcatctctggctgatccctgcagccaggtactgccggggtactcacagtgctctgggcccactgtctgggctcacagcctcatttccagggggccgggtggtgctccaagcctcagtttccccactgtggaggggatgctgctggagggatgaggatcatagaggacaacctggcagcttctgtgcccgctgcccgtgggacccgggctgtgggatgggacaggcttccccatcagggctgggcctgccgggggcacagcactctcaaatgcccacaatgggggctccgtggctctgtgactccgtggctccgtggtgctgcctgcacctctcagggcgggaagctgcctttccctgccagcctttgatttctatctcaatcatccctgccctggagcacagacctcccactgagggaaccctccccacagagggccagaggacagacagcagccttgagagccccaggagaagcaggtgaagtggatgcctggggctgcgcagcaggggcctgtctacttggcctggttgctgctatgggcggcaccactgtggtaatcgtagccactatatccaccacagtctgacatcgcctgacaataaccacacctggaactggaggcggggctgtcaggaggagcttcccagggaacagggagggtccagacagctgagccaggggcccccaggactggggacgtggggggctgcttaggtaccagacatgcacagtgtctccctggagaggcctctgcagcctcctgggctctggggcaggcctctggtcagcaggaggctgggtgctccccggcatgtgctctcctgccctcactggtgagctcctatgtggcccagtgtgggcccagctccagcgtccactcctgtcggcctggccgagggtcccggcagaactgggcatggctccttcttaggggcctcgaggactctctctacagctgtacctggggctgggggctccacgagtggtcttttccaggtggggacgacaatggcaggtgtttctctagtggcaggtgaggggaactgtccagggcctggccctgcggaacacagcggcctctcagaggagggtgtgcgggagtcctgcctgttgggagcctggcggatgctgccttcttgattccagccaggatgggaatccaggcaattggcaggaggtactggaatgaggctggtgtctacagctattcagggtcccaggaattggctgttggaatcggggcatctgtcaagacagggtctggtatagctggcagggaagggccaggtcacctgtggtcatgagtgaggtcacctcagagccctctgaagcccctatttggaggaagatggtgtgcagggcaccagcccaggctgagatggcccaggtgtccctagaggctgagggtctgggcacaaatccttgggcccggctcttgtgctcctggagagctccaagctgaggcgtgcacacagcccctgggtttccagccagtttttgccactgggttcatcactatggtagttactgtagtcacacagcaggagggcccttcacaaaaagcccgagtgtggccagagacctttcccacgcaggccctggtccaggcatttggggcccctattgacagcggtgctgcgtcctggggatctcaggccgctgtgatgccactgaggactgtcctggaagagggtgtccactggggagagaggcagggatttctggaaggttctttgtctctgaatgtgggaggcgagtcctctgttggcttccccggtgaggtctggaaatgagcaggactcaggacggccgggcaggatgagcgacgcccagctccggctgtccccaggaatgtcttctgtcttggaaatgacccaggagaggctcaggtgtcagggccaggcaggccagggaccacaggggcagggacagtgcacagggccagcccctccctcctggtgcccctactcagacatgagggctctcagtgtccacacatgtggcccagccttgagggaggggcttctgggatcgctggcctgatggcagcagatggtgctgtgaggccgtccctgtcccatttggactggcgttgggagggcagcagcgatgcagacccctcggagccagatctggatgacctgtagggtgaccttggccatctgtttcatgatctccagggctggcaggctggagcccagcgtggtcagtcacgggcctgtccatcgtgcctgctgccctgcgggtttgggtcacaggctgcactgctgtggtagccaccatacccatggtgctgtctcctcgatcaaaatcctaacatggcacgtaccggtcccctgcagggagggctgtggcgggaggctcccagggatgggtttttgatggactctgtgacactgtggttataataactccccgaaccatagtaataccacagtgacacagacctcaccccaaacctaccgcccagcctggggaaacccgggatgtccggggctgacctgaggaggcagcagggccccatggggagggctgtggcgggaagcttccaggcatgggtttttgatggactctgtgacactgtggttataataaccagtcaaaatatcgtaataccacagtgacacagacctcattctaaacctaccggcaggcctggggaaacctgggatgtccagggctgaccggaggaggcagcagggctctgaggggaggctgtgggcccagcgctctcaggtctgctgtggggacactcgggtctatccctcgcttatgtggatagtgtccgtgcccacctgtgtcctgaggctccacctcaggctggcatctgtccctatgtccctacccaccccatggccatgtcctttcgggttcataagttgcccacaaatcacagagtcatcattctggagatttttatattcccagggccaccagctgcctccacccagaaaggtcagatgtgggagacttctagagtcattccccaaccctggatgagcttctgcaccctcagtgctactcaggctccagcaagacctggagcaggtgcaggtgaggcccgaggccaggtgaggtccaggtcaggtgaagcccaggccaggtgaagtccaggccaggtgaggtccaggccagatgaggtccaggtcaggtgaggcccaggccaggtgaagcccaggccagatgaggtccaggtcaggggaagccaaggccaggtgagttccaggacaggttaaacccaggtcaggagacgttcaggtgagttgaggcccaggtcaggtaaagcttgggacaggcgaggtccaagtcaggtgaggccaaggtcaggtgaagcccaggttaagtgaggcccaggccagtgaggtccaggtcaggggaggctgaggtggatgtgtgaggcgtctgcagttttctctgggtgctcaccctgcctggtgtccctgcccctcctctcagcacccactctgtgcctgcaaggtggtggcccgtgcacaggtggtgctggctgcggaggtgctgggctctgcctccctgtgcgtgggcgtccctctcgggctctgcctggggagtgtggctgagttgcttctctctggaattcactgactgtgccgtcctccgggatatatggccctgcgcttgctccacatcaggccccaggaactgccagcaggtacccgcctgccctgctgcacagtgagcctgcaacctgtccggggatcccagggaggtgaatgccaccacacatcagccctttatctctttaaagtcgtttatttggggatacatcatcgatgtctcatatactaaatatatgtctgtatcattgtgcaattgcctgtgtcatcgcttatttatccgacctgggttaatgtctttgctattatgaacagtgctggactgagaattttctaaacacaactgtgtccattttcctcttcttgcaatttagaagtttaactgctgttttcaaggtactgtaatgtattcgttctgttcttgttaggagacttgcccaccctgtgtatctcagttcataccctcttccttccccagcagaagtaaccaccactgtgtttatgtgatcatccttttcttggttttctttatggttttctaactgggaaatgtatcccttaagaagacagttcattttgcagggtgtaaattttatttagaagaaatcacattgaaagtattttttggagtttactttgttactccaattactcagcattgtcatgaactcaaccagagtcgcttataaccctgtacttttgtgcttgtggctgtctgggtttgcatttcatgaacctgccatcgtttatttgcctgttctccttcagatggacgtttgctttgctctcagtttggggctatgagaaacacctgttgtgcacatctttgcccatgaggctctcagggagggctctggggctggcattgcctgagggttctgctttgtcacagggagttcctgccagggcttttcagagtgtctgtgcccagcagcaatgcctgaaggtgcccactgaactttgtccttgcatcaggcactttctgtgtgcttgcttctgtgctgctccacattctggagaatttattcagatctgtgctgcaaatccatctcactgattctctctttagctgtgtctacatcagctgttaagcatcccatgatgcagcagtgtgggcacaaggcaaactttcgaaagatgacagtgtaggatagcggctgctcctccttccctgtgctcttcccacgctgtcctcctgggctcactcccagccattgatctcgaacaccagtttatggaactctctgcacaggaaagcagaaacagcaaaaggccctgctcaggctctgcccgcatcccctcttacacacccgccaaagctctttccttggggcctgtgcaagcttccccagcttgcttctcattttctgtttactctgctcgctggctggtgggtgtgatgtatggaggggagtctggtgcgttttgggcattgatggacacccctgagccctatttcccagacgctcccccagcccctcagccccagaagtggaatgcgtttgcagtagggctttgggaatggggctgtgtcactgtgggtatagcatacaccattagtacaatatcctcacagtgacacgagcccccacaaaatcctcctgtccctgcgggtgtcactgagccccatcttgctggctctggctggctctcctgctgagactgtgcattccagggggtttttgtctgaaactctgggtgtcttggagaggactctgagcccagtgctgaacaaggggctcctcctttgtcctgggggagttgcatggatcctgtcttcggtcaagggaagcgcctgctggtgaaggagacctcccctcctctgttctgccagagccccctctgatgctgttgcctggtgtttcttggttggttctggtgctgggtctcagcagtctctgccctggtccaggtgggactgtgggtctgtcctctttccatggggtgttgtgggaccaccagtgagtggcttgggatgtcagtggctgtcctctggccctatggtgtgggctcgggctcactgctcccctgcctccaggtctggcaatgactccgttactacccatcggcctccagggaggtttggtgttagactccgttgactgggcgtcttcaggtctcttcccaggagaggcctgtgagaggactgggatgtctggtagccctgcattctcctgtgatgctgctgcctggatccctcgtctttagagggagtgccgagcctccctgcaggtgcgggcagtgagagacacaggcagacgtgtgtcaaggcgctggaggccgatttctttcagtgccttctgcctgtggaagggctgagctccctgcttctgtgcacaggaggctgccctgtaaccgggcagtgagggtaagggcccaggcctgcatgggaaagacttgggtaaggctttgtcccagaaataccagagccaggcctgagaggggagtggggctggagtggccaggaggaatgtgagggcatgggcagtgtgtgggtgcgagggcacggtcaatgccatccctcaggggccctaggagaggaagagctcgagctgtgggcaggaggagcacgggggtgggcacaggcaggagaaactgagggtctttggcagtggaggggagggcctgcaggtgtagggttggcctgggagaggtgtttagagggaggaagacgggtctaggtagagaactgggtgggggctgtagggacaggaccccagggctgtcttggtgggtggcaagagcagcgggggagaaagggctggaggagggtcaggtctccccagggtgtgggctgcagggtcgggtctccccagggtgtggactgcagggaggagctgcacagggtgctcccccgaaggaaggaggagggaggaagcacagaggcattggaagtgaatggagaaggaaatggcagtgacctgagtgccaggtggtccccgtctggggttggtctgtgtgggaacagcttcctggcctgtgtgtaagtggacgggggagggcaacgaggtctggggcaggaagtcgtagcagcaaggcaggtcccgggcctgggggtctggagcttatcttcttcctgtgagctgtgtgtgggcggccccagtgtgggcggtgccctagacctgtggtctggtggagcccaggcctcccagggacagcagggcagccagggctagaggagcctgaggggccaggtcagggtggccctggggccactgcctctacctgtgaccagcgctgctggggggatctgggcatgagaccccttctcccaggaggggaggtgcgtgagtgagaccctaagtccatatcccatgggggctctgaccctcctgcagggggcccgggcaagggtgggtggggtgtgcaggtgggggtgggggtggggagcccagcccctcccagacgcaccctgctctcctccagggtgtgggcttgggcactgcagggtggctgggcctgggctgcctggtgtgcccgtggtggctgcattcctagagtggggactgaggcccagtggggtctggagaggagcctgaagggggctccatggaggacctgccttggatggcacccctatcttggggaagacatggggtccagctgggaggaagggtagtgggccacctgctggggttccccctggggccacctcagcctgggggctctgtgcttggtgacctgccagaagttcctccctgcccagaccccaaagtctgtgctgcaccagggcaggagggaagggtctgtggcctgctcgaggtcaggcccacagtggtgtcccctaatcctgagtttgctcccaggtgctcgccccgcagcaggccccaagtgagggacagagatgggacgggagtcatcagggttggggtcccccagggtattggggtgtctctgttcctggagttggccctggatgtggggtttgtgcctgcgctgcgtggggttgatgttagggaggtgccactgatccctgactctctgaggacacttgtcagaagggtcaactccagccaggggcactggagccacggcagaaggaagccatcaagcccctgccccgacccgccggagcccccggcccttgtcctcccatccagtggggacactgtggggctccaggtgcacggggtcatgggagccggcagaacatgggtttggggtggctgctcccctctctggcggggcctccgactgtggccaggagaccgttttggacgaagcttttctcacagtggtagttccagttatacccactgtgactcggggctgttcagaatccgacggggcgccctgtgctctggggcctcctgggtgggggctgggcttgtgggcggggtctccttcaggggctctgaggctgtggctcgttttaggtgtggggtgagcactgtgagccccagctagcggaacacccacagagaccgaggcctgcacacattccgccccggtgtgtggggtgggcccaggaccctctgggcaggtcagcctcaatggggagggggcttgtgtcctgcctggctccttctctgggtagaggggacccatctcctggtcctggacccccttcagcctgcccttgttcttccagaaatgcaggacatggcagggtgccatggacaggagacgtctgctggcctgggtgtcaggtgcggcctcagatcctaaacatgtcctccctgctctctctgcattccgctgacttgggatggggtttctggcctggcgagtgtcactgtgggacgagctgctatactccactgtgacacagacaccttcagaaacttcctggtttgtttggggaccttcccttgctgggctcagcacaacttggtcttttctggccttgacggggcgtcctcatccctggttctggggggcctgcccctctgtctggtgtctggaataggcgtccaagtcaggagtcagctgcctcctggcctgcagggactagagaaaggggttcctcccagggcaggacgtggcagtcctgaatggagctgaggtctgtgcctgtatcgggggtcccatatcctgctccttcatggctctgagctccccctggcaggacatcctcggggtgctgggttcatcctctgtgggaggggctgctacccaggcccaggactgcagtggagggctcactgaggggcttttgggtcttgcctgagccgctgtggaggtattccactgtgagagggtcccgcacagattctcccatcctgcttctcctcccagagcctggaggggatgggatccgggggtcccagaggaggatcctggacccaggggaggggggcctcttcactgaactccccttcctccatccttccctccccaaagctgccctggcggcccccctgcaccccagcctctgtctgcactggctgtgccggctctggtgtaggtgggacttaggatggtgtggacgacgtgtggccagggtggagaggaggtgggtgagtccgtgggtgagagagatgggctcatccaagatggagcacccgcggggccctgagccctcccccacaccgtccctggtccttccctgcagcctgccactgtgggagccataggcagggtggaccataccctctaggaggctggcacctccctgggttcacaaagacggagcctcctgcctggtggtgcagtggccccacttcctccctcagcccttcctgatggcttcctggggattctggattcccatggggtgatgagaggagagcagatgggaggaggggcagggctgggtcctgggtaagggggtgctcgggctggggtccctggagagaagttctgggctcctgggggccaatcaggcaagcgtcctttctgtccacaccccaagggtcccagccagagccaggtgggggaaccataaggagagggcgtgtcctgtcctccccagtcctctagacagggtgggggctgaggggtcctccctagggcagcaccgggcagtgactctggtgtggggttgtcggatgtcatgggctggccttgggggtgcggggtacagagcaggagggggtggactctgttgggggatggcccggttatccctgtgttcaggccatttcctgccctggtcacctgcagtgaaccctgggaaggagggggtggcctcccagtctgcagccggcctgggatctgctctcgccctggaactggggacggagccattctggaggtcagcagcctcctaggactgcaggagatcaggccagcccctagcgggggaggccgtggggattttggcgaggactgcgttgtttgggagccagtgccccactaggcacagtgacagataccccagcaggatgtcctgtccccgccaggctgcccaccctatcttagccgcggcatgtgaggttgcccatccattggccttccttgcaggaatgaggccctgggatgttgagaacagatctcccactgagggaaccctccccacagaggggagagtgcagaaaacagcagccttgagagccccaggagaagcaggtgagctggaggcctggggctgcacagcaggggcctgtctacttggcctggttgctgctatgggcagcaccactgtggtaaccatagctgtatccaccacagtctgacaccccctgacaataaccacacctggaactggaggcggggctgtcaggaggagcttcccagggaatagagagggtccagacagctgtgccaggggcccccaggactggggacatggggggctgctcagggaccagacatgcacagtgtccccctggagaggcctctgcagcctcctgggctctgggacgggcctctggtcagcaggaggctgggtgctccccggcatgtgctctcctgccctcactggtgagctcctatgtggcccagtgtgggcccagctccagcgtccactcctgtcagcctggccgagggtcccggcagaactgggcatggctacttcttaggggcctcagagactctctctatggctgtacctggggctgggggctccatgagtggtcttttccaggtggggacatctacagcaggcatttgtctagtggcaggtgagggggactgtctgcagcctggccctacggaacacagcggcctctcagaggagggtgtgggagtcctgcctgttgggagcctgggggatgctgtcctcttgattccaaccgggatgggaatccaggcaattggcaagaggtgttggaaggaggctggtgtctacagcgattcctggccccaggaattggctgttggaatcggggcatctgtcaggacggggtctggtgcagctggcggggaaggggccagggcacctgtggtcatcagtgaggtcacctcagagccctctgaagcccttgtttgaaggcagacgatgtgtggggcaccagcccatgggctgtcatggccaagatgtccctagaggccgagggtctgggcagaaacccttgggcccggctcttctgatcctggagagctctgagcggagaagtgtgcataaaccttgggagtccggtcagtttttgctgctgggttcatcactgtggtagttactgtagtcacacagtaggaggacccttcacaaaaagcccctgagtgtgcccagaggcctttcccacgcaggccctggtccaggcgtctggggcccccattgacagtggtgctgcgtcctggggatctcagacctttctgaatcttctccgcctgccatcgagggcaggagggtctgactcacccttgcgcgctcctgtcccttccaggaggggctgaggtgatgtctggcaggagggtgtgcaggagtcagtcctcctggagtttgagccctggggcagatgcagggggtgggacgccttttaggggtctgggaagggctgggctgtggggctgtccctgtgggccatcttgtgttctgggggcagtcccgatccagatgtgggttcccactgtgatatcactgaggactgccctggaagagggtgcccactggggagagagacagagatttctggaaggtctttgtctctgcctgtgggaggtgattcctctgttggcttcccgggtgaggtttggaaaggcgcaggactcaggatggccaggcaggatgatggactcccagctccagctgtcctgggaatgtcttctgtcttggaaatgacccaggagaggcccaggtgtcagggccaggcaggccagggaccacaggggcagtgacagtgcacagggccagccccaccttcctggtgcccctactcagacatggggggctctcagggtccacacatgtggcccagccttgagggaggggcttctgggactgttggccggatggcagcaaatggtaatgtgggccggccctgtccccatccggactggtattggagggcagcagcgatgcagacctgttggactgaggtctggctgacctatgggataatcctggccatctgtttcatggtctccagggctggcaggcaggagctcagggtggtcacttgtgggcttgtctgttgtgcctgctgccctgtgtgtttgggtcacaggctgcactgctgcggtagccaccatacccatggtgctgtgtcctcagtcaaaatcctaacatggcacgcggcggtgccccacagggagggctgtggcagcaggttcccagggatgggtttttgatggactctgtgacactgtgggtataataaccactccaaaaatcgtaataccacagtgacacagacctcaccccaaacctaccgccaggcctggggaaacccgggatgtccagggctgacctgaggaggtagcagggcaccgaggggaggctgtgggcccagcgctctcaggtctactgcggggacactcgggtctgcccctggcttaggtggacagtgtccgtgcccacctgtgccctgaggctccatttcaggctgatatctgtctgtattgtccctacccgctgcatggccatgtccttttgggtttataaattgcccccaaatcacgcaggcatcattcaggctttttatattccctgggccaccaggtgcctccacccagaaagctgagatgtgggaggttctagagtcattctgcaaccctggatgagcccctgcagcctcagtgctactgaggttccagcaagacctggagcaggtgcagatgaggcctgaggccaggtgaagcccaggccaggtgaggtccaggccagtgaggcccaggtcagatgaggcccaggtcaggtgaagcccaggtcaggtgaaacccaggtcaggtgaggcccagatcatgtgagctcaggacaggcaaggtccaagtcaggtgaggccgagctcaggtgaagcccagaggtgaggtctaggccaggtgaggtccaggccaggtgaggtccaggtcaggtgaggcccaggtcaggcaaggctgaggtagatgtatgagacttctgtaattttcagttggtgccaaccctgcctggtgtccctgcccctcctcccagcccatgctctgtgcctgccagatggcggcccctgcacaggtgctgctggctgtggaggagctgggctctgcctccctgtgcatgggcgtccctctcgggctctggcctgggagtgtggctgagttgcttgtctccggaatgtaccaactgtgccgtccttgggggtatatgtcctcggggggatacggctctgtgcctgctccacatcaggccccaggagctgccagcaggtaccagcctgccctgccacacagtgtgcctgcagcctgtccggggatgcccagggaggtgagtgccaccacatatcaggccttttctctttaaagtcatttctttggggatacatcatcaatgtctcatatactgaatgtatgtctgtatcattgtgcaattgcctgtgtcatcgtttatttatccaacctgggttaatgtctttgctattatgaacagtgctggactgagaattttctaaacacagctgtgtgcattttcctcttcttgcaatttagaattttaactgctgttttcaaggtactgtaatgtatttgttctcttcttgttaggagacttgccaaccctgtgtgtctcagttcataccctcttccttccccagtagaagtaacgaccactgtgtttatgtgatcatccttttcttgattttccttatagttttcctagtggaaagtttatcccttaagaagatagttcattttgccggctgtaaattttatttagaagaaatcacattgaaagtattttttggactttcctttgttactccaattactcagcattgtcatgaactcaaccacagagtcacctgtaaccctcactgttgtccttctggctgtctgggtttgcatttcatgaacctgccatcgtttatttgcctgttttccttcagatggctgtttgcttcattctcagtttggggctatgacaaacatatgttctgcacatctttgcccatgaggctctcagggagggctctggagctggcattgcctgcagggctctgctttgttgcagggagttcctgccaaggcttttcagagtgtctgtgcccagcctgaaggtacacactgtactttgcccttgcatcaggcactttccttgtgcttgcttctgtgtggctccacattctggagaatttattcagatctgtgctgcaaatccatttcactgattctctctttagctgtgtctacatcagctgttaagcatcccatgatgcagcattgtgggcacagggcaaactcttgaaagatgacagtgtaggatagcggctgcttctccttccctgtgcccttcccacactgtcctcctgggctcactcccagccatcgatcttgaacaccagtttatggaactatctgcacaggaaagcagaaacagcaaaaggccctgctcaggctctgcccgcatcccctcttgcacacccgccaaagctctttccttggggcctgtgcaagcttcccagctgcttctcattttctgtttactctgctcactggccagtggggtgatgtctgggggggagtctggtgcgttttgggcattgatggccacccctaggccctacttcccagacgctccccccagcccctcagctccagaagtggaagcgtttacagcagggctttgggaatggggctgtgtcactgtgggcatagcagctggtactactacaatatcctcacagtgacacgagcccccacaaaatcctcctgtccccgcgggagtcactgagtcccctcttgctgtctctggctagttctcctgctgatactatgatttccagggggtttttgtctgaaactcagggtgtgttggagaggactctgagcccagtgctgtacagggggctcctcctttgtcctgggggagttgcgtggaccctgtttttggtcaagggaagtacttgctggtgaaggagacctcccctcctttctttctcaggagccccctctgatgccgttgcctggtgtttctcagggctggtgctgggggctcagcagtgtctgccctgttccaggtgggaatgtgggtctgttctgtttccacgcggtgttctggggccgccagtgaggggctcgggatgtcagcggctggtctctgtccctatggtctgggctccggttcactgctcccctgccctccaggtcggtcactgactcagttactatccagcgggctccgtggctgttcagtggtggctgcaggtctcttcccaggagaggcctgcgagagggctgggctgtctgggagccctgcattctcccatgatgttgctgcctggatccctcgtctttacagggagtgccgagcctccctgcaggtgcgggcagtgagagacacaggcggacgtgcatcagggtgctggaggccgatttctttcagtgccttctgcctgtggaagggctgagctccctgcttctgtgcacaggaggctgccgtgtaaccgggcagtgagggcaagggcctgcatggggaagacttgggtgagcctttgtcctggaaataccagggctgggtccaagaggggagcagggtcagagtgtccaggaggaaggtgagggcatgggcagtgtgggggtgggagtgcacggtcagtgccatggctcaggggccccaggagaggaagagctcgagttgtgggcaggaggaggcagggggtaggcacagagggtagaaactgaggctctggcagcagaaaaggggagggcctgcatgtgcagggttggcctgggaggggtgtctggagggagagacaggggtctgggtggagaccagggtgtaggctgcagggatgggaccccagggttgtctggatgggcaggaagagcagcgggggagaaagggctggaggcagggttgggcctccccagggtgtggggtgcagggaggggctgcacaggctgttcccctgaaggagggaggagggagggagcacagaggtgctgggagcaaatggagagggaagtggcagcggcccgagtgccaggcggtcccggtttggggttgatctttgtggaacagctccctggcccgtgtgtaagtggtcgggggaggcacggaggtctggagctacaagcggtggcaggaaggcaggtcccagtcttgggggtctggagcttatcttcttcctgtgaactgagtgtgggcagcacctatgggcggtgccctggacctgtggtctggtggagtccaggcctcccagggacagcagggcagccagggctagaggagcctgagggtccaggtcagggtggccctggggccactgcctccacctttgaccagctctgctgtggggatctgggcatgagaccccttcacccaggaggggagccgcgtgagtgagaccctaagtccataccccatggggggctctgaccctcctgcatagggcctggacaggggtgggtggggtgtgccgggggcggtggggagcccagactctcccagacacagcctgctctgctccagaatgtgggcttgggcactgcaggctggctgggtctgggctgcctggtgtgcctgtggtggctgcattcccacagccgggactgaggcctagtgaggaccagggaggagcctgaagggagctccatggaggacctgcctcggatgacacccctatcttaagaaggtcatggtgggttccagctgggaggaagggaagtgggccacctcctgggggtcttccacccccaccacctcagcctggggcctctgtgattcctctctgcacagaccccaaagtctgtgctgccgcagggcaggaaggaagggcctgtggcctggtcgaggttggggccacagtggtgttccctaagcccgagtctggtctcatggcccgccccgcagcaggtcctgagtgagggacagagaccggggcggggtctttggtcctggtggactctggggtggattccagtggggagtcatcagggtcggtgtcccccagggtactggggtgtctctgctcctggagtcggctctggatgtggggtttatgcctgtgctgcctggggttgatgctgggaggtgccagtgacccccgtttccctgagggactcttgtcggtggtagggtcagttctggccaggagcactgggaccatagcagtaggatggggtccagccccttccatgaccccctggagccctggtccccgtcctcaccattcagtggggttcagtggggactccactgtgctctggctgctgggggtcgtgtgagctgagcaggacctaggttcggggcggctgctcccctctctggcgcggcctccagcaggggccaggagagagttttggacacagtttttctcacggtggtcgttccagttgtacccaccgtgactcggggctgttcagaatctgccccggcgccctgagctctggggcctcctggatgggggctgggcttgtgggcggcatctccttcgggggctctggaggctggggctcgctttagttgtggggtgagcactgggagccccagttagcggaacacccacagagaccggggcctgtacacattccgccccggtgtgtggggtgggcccaggcccctctgggcaggtcagcttcaacggggagggtgcttgggtcctgttagttttcctctgggttaataggattcatctcctggccccagatcctcataggctgcccctgtccctccagcaatgcaggacatggcaggtcaccctggagggaggcatgttctggcctgggcgtcaggtgtggcacctcagatcctccatgcgtgctgtgggctgagcaggacagcagacgaccccgggcccccaccctgtctatggacattttttgctgcagcagctgtgggagctgacagtgttcacagccacaccaaggtcatcattgtagtcaaggctttctaaaagtttcattgtgaggaagcctcctattaaacggcgcctgggccctgcttcctgagggttactgctgagtcccggatttcccgtagaggcgacgagaggagagcagagggaggaggagggggatgagctgggccctgcagaagggggtgcttgggttggggtctgtggagtgaagatctgggctcctaggggccacccagacaaccatcctccctgttcacaccttgagggtcccagcaggagccaggtggggagactgtgaggagagggcctgtgtcttgtcttccttgggccgtgggacagggtggaggttgagggcgtctttcccaggggatcacagaacagcacctctgctgtgggggggcatccagcacggggggctgggctgtggggtgcagggcaggagggggcgtgcacgggaggggtgtggcccagtcattcctgcattcacaatctttcttgtcctgggcacctgcactagaccctcgcctggagggggcggcttcctagcctgcagcgtccctggagtctgctctgactctggacctggggacaggagccaggcaggaggtcagcagcctcctaggacagcaggagggcccaggccagtgcctagcagacttctgctggagtggggtccccggggcagggagataatgatttctagaagtgtctgtgtctctgagtgtgcaagtttgtccaaactgtccaccaggtgtgattaggtaaacataggcagacttgagttcaggtggaggaaactgagttttgtccttaactccctaccgactctaggggaatgagccaagctccattatcatctgtgcagaggccacagccttgtaaagggaggtggtaggggagcagggagggtgctcggggctcagtcgtcggggaagggaaaagttgcccagcgctggtcagcgtccccgggatggggccagttgtgtccgtgccggccactgttgaggtcaggattctgtcctcccagagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacggtcagttctggtgcgtggagctttctcaggcaggtgttaatggggctggggtcagcctaggggtgtgacctgaagccactggaagccttgctggggtctggctctctcttggtgcggggggtggagggagccctgacaatagagcactggggggcctccaggagaccatccctgcagcagctgggccatgctctgaggaccaggagaccatccctgcagcagccgggccatgctctgaggaccaggagaccatccctgcagcagccgggccatgctctgaggatgtgggacgaggacccccactgtctctgagtgtagggtggtgacttctttgcacagactggccaggggtcccccaggggcacagtacaggtatccctgggctgcagggctgggggacatcagagcggctctctgggcttggcagccacctcaggtgggatcagaaggggaggcagtgcctggtgcttcccctccaggcctctctccatggtgtccagggtagtttctggggctttggtgccaattcctcaggccagggtcctacccttcttggtgccgtgatgcttgggggctctggaggaagccccagctttggccactcctgcactgcctggggctccagtcctgctgcgccttgaggggaacccagggccccagccttggccctgtaaggtcagatgggggctgggctccagcatcctgccgcttggtttagttcctaaatgacagggaggcagactctggctgagctcaagacctgtccccaggctctgcaccagagcagggtcccccagcagaggctgtgtggagctgggcagggttcccactttgtggggagttccctggacctggagactcaaccctcagcctccttgatgataaatgatgcgtcctgtgactgtcttggcccagaccatcagatggcctcctcacctacccctcttcagacagggcctcagacctaaggcaggagcaccccctatgccagacctcctgggtcacaggatatgcacggacattgggaagggatggaggatggacggaggaaggacgtgcagttgcagctctttctgcagatgccctgagagaggaggtaggagcacccttgctgtggtttgaatgcttctctcctccaaaactcatgttgaaatttcattgccattgtaacagtatgaagagtgattaggtcataaggtccccacctcatgggtgggattggtgctgttataaaagggtgagttcggccccctcttgctctctttcttgccttccgccatgtgatgacacagcaagaaggtcctcgccagatgctcctggacttgctttggactttcccttgctcttggacttgctctggcacctgtgctcttggacttcacagcctctagaactgtgagaaataaatttccgttcagtataaatttcccagtcttgggtattctattctaacagcacaaaacagtctaagacaaccccaaattcagacctaaggtgagataaccccaaccaatatctaaggatcccctgctccagaccttggtggtgaggtcaatacaggactccctctgagggaagccctgacagcgatgcctgggaaggcatctctagggcccagtgggccaggggaggcccaggacacacctgcatcatctctcataatccctccattctgttataacaggagcatatgcttatagcatactttaaaaattagcccaaaactgaaggtaagcatcgattaattgatggactccttttcacagtttggtctttgtatttacaccagtcatctcacaatgcgtgttgagctttgcacccttttaccaaatgaggtcaccccatgaatgctgtcatgttatcacagatatgcggtaagtataattgggaatgtttgcggaataatcccactaattttacaccacagtcatctcacaatgcgtgttgagctttgcacccttttaccaaatgaggtcaccccatgaatgctggctgtcacgttatcacagatatgtgacaagtataattgggaatgtttgcagaatagtcccactaatgtatgcaccataatttcttcaggcactatcttgctttcaactattttataattataaataatgttctgaagaatgtctgttcacaaagtgttttccttatgtgtgctagccatttgttttcttttagaaattgtgttatatcctttttgccgatttcttaagggatttgttctttttcttattagcttatgtatgttgtttgcataataatggtacaagacctttacatattagattaatattatttgagtttattatttactcttgttttgatgatttttaaatgtaaagaatctgtaaaggtgttacctagcttcatgatttgggtttgcagtgaagcctgcccaactttaggcagctgtctgggcctgtgtttccagagcttgaaggagtctctgcttccctctggagggctggtgtgatatcagtgttctctgtccaggcctgggtgccctcctgggtctgggcttgggctgggctcttagatgtctcagagaaattgagactctattaatcatctgagtctttccatttctggtgagatgatcatgggtcatcattggcctgagtggtgggatgagctataaatagttctaaattcctggtgtaagtccttgttcaacgagatggacagaatttggccttctaggatgtcatttataacatttggctctttgccaaaatgcaagttagcccatgttttactctggggactgtgaattgtgatccctttaatagactttcccatgttcctccaaatcctggagcagttcttatgggaactgattagttttgtgaaagtctaaacttcacccataaagccatcttggcctgaagtcatctgtgagggcaattatttaataatcttaatgctttcttgaggattactgttccaattatgatttccatttctccttgagtcagctttaagttttattgctagaaaagaaaaatgccaacttgccgtcatctctgctgtcactattttgtgttcaacaattgccttctctatctgctgtatctttttcagcacagaagctgtaatgttattaaacaaagcaatgtatccagatcactcagaatctatgcctgtcacggggagcaggagaagagggtgaatgaagagccacagcatggcaggggagccactgcaaggatgctgaaactcgtgtgaacagagttgctgtaggcaggctgctatggaaccttttggggaagcactgcctcttagggatggcagtgaaaatgggagaagagggtggcattgcctccagatggaagatgtagtgctttgccttgctccttggtgcttggagagggaaagggatgctgctgtaaagttcctggctggactttggcttgataaagcacgggcacctttgggagtatgagggtgggtgggtgtgcacatcttccatgaaggaactgttaatattggggcagatgtttcaagtatggcagacaaaggatgttctgcgtggggaaatgtggtgacacccatttcacaaggacagctcacatagattgagtgctcaggaaggaccagcaccatacccagtgcctgatgtgtatcatctcaattagtccttgcctcagatgcaaaaggaaaccatcgccatcatcatcaccaccatcatcatcttcctcctgtgcagatggaaaggctgaggcatagagaggtgacggagtctgcccaggactgcaagcctgctggtggcagagccaggttccaatggaatgaaggctgtcatcctcagatggcagggtaggcaggtggctagagctcacttgggagaaggggaaaggacactgactttggctagggatggagcagagcttgggctggctttccatgcacgggcagggggcgtggctcatggctacgctccagccccgggtgtggacattgaatcttccaggtctaccctaggctatgggtctggacagcactgtgatggaaagaagacactctatgtcctgcattctgtgaccaatgatgtgactgtgggaatggcgctggcatctggctgccactctgggacgggtggccagctgccatcaggccccacccaggatgggaccaccatgcgacttcttccctcgctcctcctggtcatgtccagagccccaggaggaccagcaaagcctctcgagccgatggcagctcacgttctaccttgtcagctactcctctcctgggcaacattggctgcttgctgtggctctccccggggtatgtgactgcctctgtgctgggcacctggcctgggctttccttctgggcctgggcagctgggctcagcttggacccaggcagcagccacagaggggcccatggaggtgacagagttgcttctatgatggtgaacgggcagctgtgacacggaggaggcgaccactcctcagtttccaagtgctgcggtcagggccggggccagcaaagtccctcccatattcaaagagtgggtttgggtttgtcccaggaggacatagtcaggagcccatgctggcacatgcctcctccaaagttcagcctggatccccagcctctgccaacggccccgctccttagctaacccagcttgctcctgggttccacggcggagtcagatgtttctgggcagtttcacctttgtgccttaaatgcatgttgaggactttaaggaattgtggagaaatagggctgtggcaaaggcaagtgacaactgggaacaatgatcctgcagaggctgctgaggcctgggccccaggggcgtgggttcatccttctgcctgggctttggtgggaggggcagactctgtggtctgagacacaaaaaaacccaaaacatacgtgtgtacagacacacagcagagccacacacacacttgtgcccatgcacacactcacaggaggcccgtggactccgcacagggaagaaactcctccggtcgacagtggacggcgctgcagcagggactcacccccaagccctgcctgcctcccattgcccacctggccctggcttgatgggcttatctcatgctgtggccggggacctcttgcttcctgcaaccccttgctggactggggcctgggcctctcctgggctgtgcctagggtttgtaacccagggcctgtgccggcgtgcacagagcatctctccctgggaggctcagggctgcctcctcgagctctgtgggcctgcactggccggtgagcttgtggtgtgggttttcaggctgtatccttctacctcctgagcccaggggtcccaggcgccctgcagctgtctcctcggccatcctgtggggccccgaggccttgccctcacttcagtgcctgggtgctcaggctttgcccaggtgccaggagaaggtgtgagcatgagcctattggacacacctggcgacgtataccaggtgtcccacccctgccaccatggggcctcccgatacggcaaccaccacggacctgtggggaccaatgaggaaagagagaggcaggtctgggccaggctcacagggactccggcatagcagaccctgccccagcaggcccccttgtccttcctgggtcctggtccttcatgaggaactagcccatccctggtggggctcccaccccgcttctcagtgggctctatgcttgcctcgtcggagtcacccctcaggcagtcctgggatcctctcctttagacccactgtgccttcccggcctcccgggcttctgctgggggcagaagaaatgcctccccaggtctgtctctggaggctctgagggagatgggcttgggggctgtaggaggaggcagggattccagggtgtcaggaaggcaggggtgccaggtcccacctagtgaagtaataaaccgtgggtggtgatagtgacccagtgccctcactgcccagccccgcctgtcctcagccagcactgcagggatcccaggcccagactctggaggccttcactgatcccagccaccccagaaaagctgcagcctgcaggcaccagccgggccatatgcccagtgccagctagggcccaccgcccatcctgcacacggggccgctgggcaggtgcccctcacacccccaggatgtcagtgctcacctcgagcaaagcgccccagctcggccttgggaggtggtcgtgtccagggggatgatggagagctgtccaaccaagagagcgggagggagggaaggagggagggagagagatagagagagagagagagagagagagagaggatgtgtgggccctaaggctgccttagtggaggtgcgcgtggcctgcacctcaccaagcctagccactctcgcggctctgagtggctcacaggcttgtgagggccccgtcgctgcctgctgggtccccaccagggctccctctaggaatgcgccatggctgctatgacaatttgcacagcccagtggcttaaacaccatttataccacaggtccagatgaatcctgcagggccaaggtctgggggtgctggaggccatgctccctccaggcttgcggggagaacttccctgcctcctccagtctctccatccctgagctctcggctcctcctccgtcttcagggccagggcgtagcgtctgctctctcggcctctgcctccgcttcccacctcacctggcttctgtctatgtcagtctccctctgccaacctcctagaaggacacttgtgattacattagggctcacccctttaatccaggggagcctctccacttcatgattttcagctaacttgcttctgcacagaccccctttccctataagggcacacattcactggtcccggggctaaggaccttgctccaagtccctccacccatgatgctgtgccttccagaaacctgtcctctgcagctcggtcttgaccccaagcctgctggtgacctgaacttcacagggttatccccttggactgtgtgcagcacgatgcaatttctgggcctgaatgtcatgctccctggggcaggaccttgagcctgcagcacacactaggccacctgcagtctcacaggccatgccctgggtagacagggaggtgctcaaccccagctcgggtcctctagtctgcctggctaccatgcttctcactctcctgcatctgcagaccctgcgttgccatgtgaggcaggggtggggtggggctgagggcgtggctttggtccctggctgtccggatgaagtaccagagtgacgccacagcccatcccggtgacatgctcacccccaacccccgtgtccgggaccccggtcttgtgtggtccctgatgtggagtcctcagtccttaagatacatccagaaagtcctggccatgaattggaggtgcagagtcctgcagagcctctgggctgggctggtgcccccaggagatggagggcctggtggatgccctcctccctcagagctggggcagctgcctcccaggggtgggactctgggctcagagagaggcccttgagctgcagctcagggggatgcgaggcttcgtggactgtgtcctggtccatgtggtgcacgtgtctccacctccaaggagaggctcctcagtgtgcacctcccccacatccgtcctctctgccggccccgggcgtctgagcagtcattccatgccagcacctctgcagcctgctgggcctcaggttctctgtgagggacctccccggccttcggcggaggtggagtaagctccgtcaaggcaggtggcttcgtcccttcctgtgagtgacaccagtgatgaaatggacccctccacacaggcatcctcagggcacagggccctgggggcaccttcctcctttcgtatttgttgagaaaaaaagtggcattgcgctcacaccaggatgctggagcagagctgacatgctcgggaaagggcagaggtcactgggggtgggaaggtcatccagtccagactcagcacctcgtgggctggtaaactgaggctcaaagtgctggtgccaggcctgaggcctcgcggtgacccctctctctggttcccagcacctgcctgagacctgccccaggcacccataacctggaattccctgtttccttgtccagggcctgaggaaatggctccccaggtctgtctctggatgctctgaggcagatgggcttgggggctctaggaggaggcagggactccagggtgtcaggaaggcaggggtgccgggtcccacccagtggagtaacaaactgtgggtggcgtttgggcctccccgccttccccactgggtgtgctggtgctggcgctgctgggtcagggctgcccgtgaccccagacaccactgtccatcctgtgaggctcccgtctgggcatgtcctgggtggattcctcctttctgttaagtagctacatgaggcaggggctcctggatccaaagcaaatgacaggaattccagagccaggtgcatccactcagggcagccagtgttggtggagctgcctctagcacatggaggagagtgaaagtcagcctgcccctctcacgagaaaagaacctggggatacctctcagcctccagcgttgcaagtgcaaggccagtggagttaatctgcaacgtgcacgagggcgtgtgtcagtggctgtgtgcaggagtgtgagtgagcaagagcaagagcgcatggctcctgctgtacctcaaggtgtgggctcctggtggctgctcagtgttcccaggggtgagaggcctcatgtatcctaggctgcctgagatttctgtgtgctgatcgcatcctcagtttcttgtccaccgcttcactggcaagagtcccaggctccaaggacaccctccctgcacatgattgggtgttaatggtggcctgggttgtgtcttcccctggggatgagggttgggtgtccatggtgccctgggctgtgtcctcccctagggatgagggtcgggcctccacgatgccctgggctgtgtgctcttatgggaatgagggttgggtgtccaagatgccctgggctgtgtccttccctggggatgagggttggatgtccaagatgccctgggctgtgtactcccctaggaatgagggctgggtgtccaagataccctgggctgtgtcctcccctggggatgagggttgggtgtccatggtgccctgggctgtgtcctcccctggggatgacggttgggtgtccatggtgccctgggctgtgtttccttggggatgagggttgggtgctatggcatcctgggcaggtgcttcctttctgcacaagggttgggtgaccatgatgtcctggcaatggcttccctgggttgcctcttttctgccatgtgggaagagcaggggaggtttagttggtctcagcacatcattctctcaggataagtagaagagtgtctgagctgtgaggccagtgctccagctttggaattgtcttccccaccctcacctccatcccatcaaagcccgacatgtcgtgtggcagcagcgaggtgggtgttggctgttctcttgggctgggggttagtcgtggacggggaaaggagagatgctggtcaaagggcatgaagtttctgctgatgggaggagtcagttcttttgatctgttgcacagcatggtgactatagttaacaataatgactatttcaaaattgctaaaagatgagattttaaatgttctcaccacaaaatgataagtgtgtgaggtgatggatatgccacttaccttgttttaatcatcccacaatatagacaggcattgtcactttgcattgtaccccaggaatcttcacatttgcttttttgtcaattaaaaatagagacacaaaaggagagaggggagagcaatagactcttcacggaaccgtgggcttctgcctccgggtaaaataaactgcaaaaaggattcccaggaaaccgttccctctttcagcccttggttacaggaagccggatttgggaaatctgcctggatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatataggagaaaccatggtaacgtaattagaatagtcagagaaaagtagccagaaatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatacaggagaaaacacggtaacgtaattagaatagtcagagaaaagtagccagaagaatttgcaacgtgcccttgtaacaccaaatttgatcagttttttaaaaaatgatcgttatgtaggtgattgagaagtaaatgtattcttttttaaggtaaaaatttggacccttatcatgcatacccccctctgtgctcttcaaatcaacatcattattaatatctgtacatttttgctcatctgagccagcacaggctgaggctgtcagaatggacaccttttggttgttgggtttctgtcagtttctggggtgaagctgcgtgattgagaacgtagctcttggctgccatctcggggattattaaggactgtgaactctatccacaagccatggcaatatctgtcccaccgaatgctccctctaacacactcttactcccgtgatgtgtgttaagggctccgatgatgctgaaaacagcacaggatgtgaaaaggcaggaacagttctgaagtcaaaggctgatgtcctgtttctctttccctctgtgaccgactcccttcccagtggtaacaagtacccacagcttggtttgaatttctgcacgctgttgtctgtgcactcgctcacacttacgcacacagcaggcatgtgggcgatgctgggtattttgtgtatgagtgggatgcacatacacacatctacatccatatcatgcccatgcatctgtaacttgcttttcccgtgtaagaacacttcttagagtttgttcaatgcatgtgtctgtgtgaatgattgaaggcatttctaacccattttaaagatggctacttaggaccatatggatgttgtactgatgtcatttgaccacgtccattgtttccatcttttgggctgttcttgtgtattttactttccatgtaacactgtgacattgagaattggtacctacaacagtctatttgctttacattaaatttgtaggctaatttgtgtaccttcagagtgtgaaagttttctcctgaggaaaatggggtaattcatgtttattcaggttttcttcttgtcttcccatgtgctttctagtttactttataaataataataatgtactcttactatctctcagtatacggaaagcacaagtcaaagaatatggtgtgggttctttatttaaatcttcacaacactaatcagtggcagagtgtggatccttgccccccagcacgggactagccagtggcagagtgtggatacttgtccccagcatgggactaaccagtggcagagtgtggatcctcgccccccagcacgggactagccagtggcagagtgtggatacttgtccccagcatgggactaaccagtggcagagtgtggatcctcgccccccagcacgggactagccagtggcagagtgtcgatcagacttctgggaccagtgcccattttcccaatcactgcacagtatagccttggatggcatgagctaccttggtgtctaggtcgtttgttgttcccatgaatgggttttctctttaaattacagtgctatgaataaagctgtttcacacaaataacataagcgcagtctcactattaaaatgcaaatacaaaataggaaaattggaacttacttccaacagctcacctgcagccgattgtaccttcctgtttcctgctggccacgttgtcatattttctgctaagtaaccagcccatctgcagggtctttcggggatctcaccgaggccaggtgcaaatcatcagtcttgcagtcatcaacaaacaatgctgatgataaaaccacacagaaaataccttgaaatccacagctacgcagcaacattgctcattagtacatcccattctttgaccaggggtgagggccaggcaggtacatcatttatcacttacatgataggtgcagctgtttaagtagaatttctcaggccaactccaagcccgctgtaactaaaactcacagcatggtgttggagggaaatgtttagcagcaaatatccgcatccagacagaggaaaggcctcaagtcaataaacttagcttccactttaggaaactaagaaaatagcaaattaaacttactgtaggcagtagaaaggaaatagtaaatatcagagcagaagtcaatgaaatgtaacacaaaaaactagggaaaaaaatcaataaaaccaaaaccagttttttaagaaaatcaatgaaattaaactttaggcatactgattagagaaagagagacgacacagatgagcaagatcagggatttaagaggtgccatcactacagattctacagatgttcaacctctaagagaggaatattgtttaaaaaaattttgacaataaattcaacaacttagataaaatagatacattaattgaaagacactggaaagctcactggaaaaggaagagaaaattgaatttttagttaaaaactttcccacagtctgtgtgcagtggctcatgcctgtaattccagcactgtgggaggctgaggcatgaggattacttgaggccaggagttcaagaccagcctgggcaacataataagacctcaaaaacaagacaaagcgataaacaaacaaacaaacagctgggtgtggtggtacatgcccgtagtcccagctactctgaaggctgaggtaggaggattgcttgagcccaggaggttgaggctgctgtgagctatgattacaccactgcattccagcctgggcaacagagtgagactgtgtctcttaaaaaaaaacccaaaccacaaaacaaacaaacaaagactttcccacaaagaaaactctaggccaatgacttcattatgaaatcttgcaaacctttaaggaagatataattccaattttatacaaattctttcagaaaaatgaagaggaggaaatagcttcccaactcattctgtgagtccagcattaccctgattgcaaaactaggcaaagttattataagaaaaaataccctacagactaatcttccttgtaaacatagatgtaacaattcttaacaaattttgaggaaattgaatccaacaatatgtaacaataacaacacatgatgactaaatggggtttgtctcaggaatgcaaaattgccttgatattaaagaataaataaatgtaattattcatgttaatataagaactgcataatcatcttagtagacagaaagcatttaataaattctagcatgagtgtcacattaaaagactctcagaaaattaggcataggagcaaacttcctcaatgtgatgaagggcatttataaaaaccctacagctaacatctgacaccatagtaaaagaccaaactccaacgttaggaaacaggcaagaatgtctgttttcaccacttctgtttaacattgtactggaggtcctacctgctgtaacacagaaagaaaaagacataaatttatccccactggaaaagaggaaaatctgtctctatatatagaccacatgactgtttgtatggaaaatcctatggaatctaaacagtgctgctaaaattgagaggaaatttagcaagtgtgcaggacataagatcaattcaatttccttgctgtttgaagaacttcctttagccagtctttaagagtacatcttgtagcaagaattcttttagtttttgtttatttgagaaggtatccattttctgctcatttctgaaggatagtttcattgggtatagaattcacaatcaacaattcttgaacattgaaaagtatctgagaaagactccagcatttgaattggcataattgatagctaatgcgatcatttctctcttgctgctcagtgcggtcactggggcagtgcatggaatagatggtgttcagtccatgtgtgtgaccactcaacatgtatttgagcaggtgggccaggtgggcgctgaagggaggctgagtaggtggtctggtgagtgcttgtctaagcaggacttgccagagcatagccaaatgcaggacagtgagtcgcagagtgggaggatggtttggagagagggctcaaaatgacataggggagggaaaatgtacttatatttgtttctatgtataaaggtgataagtttattgtaggaagtttgtaaattataataataaaatgatatccattcaattctacattatccaatagcatgtgccacttacaacattgagcagaacgaacagactcccccgcatggctgggttctcatctcacggctggagatccagatagggcatggccatggcataggtgtctggcaggaatctccttaaatcatccctggtcatttataaattccaaactgatgagctattatccactcagaccctactcaaatcactctgcccttcctgaccaccacccaaaccaatgcctcccaacctggtccctcttcactaacagcatggagtgtaaggaaccaccaagttcaaagcaaaggccttaaacaccctgaaaataagaatttgtaaaaacatgaatgaaactgccaatttaaaatattacctaaaaaataaatgtcaacaggatgttttattgccaagctgacaaattttaaattattaattcaaagccatagtgtattagtccattttcacaccgctataaagatactacctgagactgggtaatttataaagagaggaggtttaattgactcatagttccgcatggctggggaggcctcaggaaacttacaatcatggcagaaggtgaagggaaagcaaggcacgtcttatgtggcagcaggcgagagagagagcaggggaacctgccacttttaaaccatcatatctcatgataacaccctatcatgaaaacagcctgggaaaaaccacccttgatctaatcactcccacctggaccctccctggacacatgggaattacaattggagatgagattggggtggggacacagagccaaaccatatcacataggaacctaataggagaataaagtaggaaaacttccacatcagtaaccctttatcagttggtaatcccaatctgcaaaataaaactatgtaattttaccaagataatggaatcttctctacagaaggattttccagtgcaaaagctccccaccaccaccatgaaatgcaggtgaccatttccaatttgtgtaaagtcctcagttagtactgagacttttgaaggtcaaaaatccctttgctcatgctgcatgatctggacgagacataagaatttttagctaatagacatgcaacagcttttgtgtgaaagatgttataagacatttaaggtatttgcttatgattagtaagtatttgttgtatcattggagcacatgtgcttatataccctggaaaaattttcgtcttggaaaagtattattttggggaaaaatatcagaaaacatattgttagtctttgtttatagagtctcagccttctaaatttgaaattattggcagttttcctccaattgtaatgacaatcagccaatttaaggaggttttccagttgcagaatttttatagaggtgtcctctgctgaaatttcagtattcactacttcttaaaaacccatgcctggatggagaatgacatcagcaagatggatgaagaacttagagaagcctggtgttcacccacaccctccccatgaggaaggaataaggcaaagaagaaacagctaaggtttgactggagtgttgaagggagactgacggagtgcagtggaggtgtggaaacgcacccgtggtgatcggagggcagcatggaggcacctggcctttgcagccttgtcttccccacccagatcggattggtctggacacaggagggacttcccatgtagggaaaaggtaagcagatttcccgccagcacccactgccactgcaaacatctacagcccttgcaacaggagaattccacaggttttgcaagccctcagccaagtttgggagctgccaggaatgatcccagattaggagcacaaggtgtgtactccctgcccccattcatccactgtgagcctagctgctgcagcccagcgccaccttgagaccggagccgcctctggagtgcatcctgccctgaggctggtagccactgcccctttctagcattggggctccatcttcaggatgcccatatctgggtggctgaatgccacaaccctggctgtgcagagcctaggctgaggattggccgtgactctggccctgcacagcaaaaaacccaacccctgctgctgcacatccagctggaggaagagcctgccaggcctgcccagggtgaatccaccattgatttggccaagctgctgagggccctcccctgagcaggagaggcccctgagccaccgagcacctgatactaactccaggctggcagagtggatatgtgcccacactcaggcacctgagaaatagccctgtggcatccactccaatttccacaggtatgccgttgacctgcccaaaggctctgcacctgaaattaggcctgagaaacagcatcatgggccacccctggcaggcactcctataagccagcaagcagctgtgcgcccatgaccccggcctgagaaataaccctgtgcccctgcagccccccagcagacacacacccaggccagctgaggaagccatgtggccatgtcctgggtctgagaaagagcccatggggtggccctgggagacacatgcccaggccagttgagcggccatgcacttgtgtcctgaacctgagaaacagccctgtggattgccctcagaagccacacccccaggccagccaaagagacttgtgtttgcatcctgggcctgagaaacagccccatgtccccaaccctagtgagcctggcaccaagttggtcaatccaccatgtgcatgcatgtgcctcgacctcagaaacagcctggtgagtccacctctagcaacgttgcacttccactgccacaaacctctcagcccaggccactgagacactcgcaaacgtcaccaatgtggacggcagctgaagaaacgacatggagactacgctactgcgtcaacctagaactaaagccagcacgccccgccacactgacaccctgagacccgtctgtactaggaagtcttttcctgcaaaacctactccattaaattgcaagggatgactggtccgccagatgtgtagaaatcaacgtaggaacacataaaacatgaaaaggccaggaaacacgacacctgaaaaagacaacagtcattctccagtagcagaccccaatcataaggaaatatacagaatgtcagaaaaataattcaaaaggataatctctaagaaactcagggagatacaatagtgtacagatagaaaattcagtgaaatcaggaaaacaatttatcatttgaatgaggaattcaacaaagagataagtatcataaaaaagaaccaacagaaattccagagttgaagaattcaatgaatgaaattaaaagtacaattgagaccttcaagattagactaggccaagcaaaagagtttctgaagttgaagacagatcttttgaaataattcaggcagatgaataaaaagaaaaaaagagtaaaaaggaatgaagaaaatccccagcatttatgggacacaattaagtgaacaaatatttgcattatgggtattccaaaagagtagggaaatggtgtagaaaacacgtttaatgaaatcatagctgaaaacttcccagatccaggaggttcacagaacccaaaatagaacttctttgaggcacactgtcaaaagtcaagttgtcaaaagtcaaagacaaagaattccaaaaacagcaagagaaaaacattgtcacatattagagaatctccattagactaagaacagatttcaaaaatatgaaaaagggttttctatgatctctgttgctgagccaaaaaaaaaaaaaaaacaacaacagtttaagacacagcaagaagttccatttttgcttaactccacacctgctcctggtctgggccctgcgctggtagtgctgggtgccttctggggtcctgagcatccctgcagggaggtttgtgtctgggctcacactgacttcccctcactgtgtctcttgcacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgacaggacacctggagacaaaaggaaacagcaaagtgaaacacccctcagtctgtgaatgctgctgtgaatacggcatctccctgacactgaccccatgggaggcccagcacgggcaggaagatgaggaaggagacagacattgtctggagctctggtgactgccctggtcagccagaattcagcaggctctgcagttctgcagcgggggaggctacatttaaacaggaaaccacaccctggcatttgcctgtgtgcgtcacttgctgatataaggccccgggacggagatggctcattgaagagccggggccctcaggtctacaactgggtttccctagagccatgttcttcagcagattggatgcaaagaggagctcagaggcagggcccctgggtgtgatgactctgaaattccagcatttggcgtcctacatcaaccaaagtctatatacccttattcatagatcagatccccttcatttattcacccattcactcattcatgcaacaaatcctgagggccgatggtactaacccccaccccctggcatgaggaggcatccctaggcagatgcaccatccctgtgcccctggggccaggtgccaggtccctagagtaagaaggctcaacacccacaccaccccaggcagtcccaccacttcgggagtgaagggcagcaggtcagcattctggtccaggaaaagcctgcagtggaaaggagaggggttttgcttctgtgtggtggggcaggatggagccgagtgcagggagctgtgagcttctaaagggaggtccacagagcacagtgggcaagggcagctcatcccaaaccccaagggtggtggaaacaccccaggatggggttggatgggtgagtaggagcttttttttttttaaccacctcaatcatgaatctgcaagagtgagagctaatgacaggtgactatggcgcacacagtgtctaggaggggcctgtttctgtccagtgacactttctccttacatggccccagagtgtaacacccgagtttctgtggttctcggggcctacagttctaccctctactcctcagtactcacatgcgtcacccacaggcgttgcatctgtggggtgggaacgggggtgccaccactcctcaccacatccaaggcccactgcaggctggctgatctgtggggatttgtggttccagggcatggcaggtcagctgctttccggaggactatgggtggatatctcctgggcatggagctcaccgcacagccaagggagggctcggagtgcactggggaaaggccgcccccagggcattcctggtgactggctggggctgtgaacgtggaaactgcactgtgtgaggagagggcgaggcagtgagtgtggctgcctcccagtgatgtgggactgtgcctctgcaaggggtcgaacccgtgtcctcctgttgatggtggacccattgtcctcatccacacctccacaggtctttccctgactcactgtagaacctgactatggccccgatagacaaagactttcccgcctgcattctcggtctacagcccatcctgagcccagggcgaggtccaggcttgcacaggaaggaggcactgatgggcacggggtggactgtagccacggagggctgcacagggctgccaggcgaattagcagactcctagctcccaaatgcagggccagtttcctctcaggaacctaccctcatttccttggtagcccatttcatgcactgggctctgaagagttctggtgcaggatgaggaggtggggctgaggtctggacagacaaaggtgtgcgtcccatggggcccacatcgtggggcttgggaatgatgatgtgtccaggagagggcatagcctccacgcctcgttcttgagagggcctgtggtgtggctttggaaattggataagaatggtggccgcagctgctggtgctataagaacggtcacagctgagcagcggccacagtcccccgagagtgtcctctccaaggcatcgtgcagctgctaacaccacccacccagtgcctgcgcgtcctgaactacccagaaaacctacctcaagttgaaaggaaaaagcaaaactgtctctgttcagagattatatggttatagacatagaaaatcttaaagaatctgaaaaaaaaataaatccccaaaacaaaaacggactgttcaaactaagaaaatcaaggacatttgagcatattagcaccaaacaattggaaaattaattttgaaaggaaaaaacttgtgaagacataaaaagcaatcaggatataccttagaagaaacataaaacgatgtggagttctttacacagaaaattgtaaaacattgctcagaggctatgaacatatgaagagatacaccacatattggatgcatggattggaaaactcagtgtaattgagagacaggactagctggatttcctaggccgactaagaatccctaagcccagctgggaaggtgaccacttccacctttaaacacggggcttgcaactcagctcacacccgaccaatcagatagtaaagagagctcactaaaatgctaattaggcaaaagcaggaggtaaagaaatagccaatcatctatcacctgagagcacagcgggagggacaatgatcgggatataaacccaggcattcgagccggtaacagctaccctctttgggtcccctccctttgtatgggagctctgtcttcactctactaaatcttgcaactgcactcttctggtccatgtttgttacggctcgagcttcgctttcgctcaccgtccaccactgctgtttgcccccgtgggagacccaccgctggcttccatccctccggatccatcagggtatccgctgtgctcctgatccagcgaggcgcccattgccactctcgatcgggccaaatgctcgccattgttcctgcacggctaagtgcctgggttcgtcctaatcgagctgaacactagtcactgggttccacggttctcttccgtgacccacggcttctaatagagctataacactcactgcatggcccaagcttccattccttggaatccgtgaggccaagaaccccaggtcagagaacatgaggcttgccaccatcttggaagtggcctgcggtcattttggaagcggcctgccaccatcttgggagctctgggagcaagggccccccaataacataattaagatgccagttttccctaaataaaatctatagtttaaatttaatccaaatcaaaatcccattcaacccagcaattcaattactggaatttctccagggtataaaagcacatgtgctccaatgatacaatgaatgcttagtaatcacaagcaaataccttaaatgtctcataacatctttcacacaaaagctgttgcatgtctattagctaatgattcttacatctcatccggaccatgcagcatgagcaaagggatttctaaccttccgaagtctcagtactaactgaggactttacacaaattggaaatggtcacgtgcatttcatggtgagggtggggagcttttgcactggaaagtccttctgtagagaagattccgttatcttagtaaaatcacacagttttactttgcagattgggattactatcggataaagggttactgatgtgggaagttttcctactttattatccttttaggttcctatgtgatacggtttggctctgtgtccccaccccaatctcatctctagttgtaattctgatgtatcaaggaagggtccaggtgggaggtgattacaggcatctgccaccacgcccagctaatttttgtgtttttagtagagacaggttttgccatgttggccaggctggtctcaaagtcctgacctcaagtgatccgcctgcctcggcctcccacagtgctgggattacaggtgtgagccactgcacccgggctccaggctacacttgaagcatttcttaggttcagttcagagcagcctttagtcctgaattaatgtggcaccactactcacgagattacttcggaagattgcttgaagctttacatatctcaaggtctttccaccctggctgggagaacacaaacaatgctttccttgtgtaggctctgtgtagttttgggtccacaggtttctggtgatttccccctgatatcgagtagtttcttttcatgcaggcataagtcaggcataagtcagttctcagccccaaacctgagggatccccctccctgcggcaagtctccagctgttctccccccgccccaccccggcccatcctggctgcacagcagcctgctccccggtgctcctcccctcgggctgctgctgccttgaactctgctctctgtccgctcagctcactaagcctttccgtgtgtcctggcagctgctttcaggcaatagcaggattcgttcatttgtttttcttttctcaggggttatgatcctgtgatgcttgtttccaaatgtctgaaaactactttttcaaaacatttccacctcagtgttctatttgtttaaggaatgtgggtaagtgcattttacccacagggcttgaaccaacattcaaaattttatgttagaacctgttaaagacaaagggcaaaactgatcacaaactcaaatgcaggacagttgcactgcgattcttttttcgttaggttacagcccttatgtgttgtactccgcgggcgcaggctgagagccgtctgcacctttgttactgcggcccgacgccctcttgccagggccacagcagcatcccccgggtcaccgagccggggctttcccacgtgcctccttacaattgctatgtttctgcaagcagaggcccaaggaagtatgaagcactcctcaatatctaaattagctagcaaaactctacagggtgattaaaaaaaaaaaaaaaacaactgtgaaggtgagaggtgcagtgagtccttggcagaggccgtttgctcagggaaagtaaaaccaatgacctgactcaacgcggacacgtctgccccgccccctaaaacctgcttctggggccgctgtgtggtctggagcgccgcctggtggtcttgtgcttccctgcagggaggtttgtgtctgggctcacgctgaggtccccattctgtctcccacgggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctgaaatctctgagacactcacatggaggtacagccatcaggcagaggacgacacacagagatctcatgttttcctcaacaaggggctcgactttctcagtggcctctccaggacagaacaagaaaaaataactggctgtctctagcctgaggttgcatttcgctgggtctctgggatggaaatgtgtcttgtgtcttcaggagtctgcagggcagccgctgctgtgactcaggtagaaacttctctcccctgatgtcctggcccctcgttatccctgccacagtgcaatcagactgggcaccgctttagggagaaacggaggacatggagtgagggcagggtagtggagactattgaagagagtcaaaactctccaggggtagagacgcctccaggaccccttggcattgttttcttcactttgcaggagtaggaaggagctgagagtctagacagagcctcagatgcacaaccctgatttggcatatcggggagcaatctcatcagcccaggagaaggcccaggagaaggggcagctctttgtgcctctgcagagaagcggcagggactgggaggacattttccctgcccagcaggtggtgctgcctccttgttccctgcctggcacagcctcggggtgcagctgctggctttcccagggtctgtggagagcgtcttcttggtacttccttaacgtcaaataaagtgaatgccttctcaatgcacatcttaattcatcattggaaaggccaagacacacgcacacacacatctatatgtttttctgacaagagctagagacaattgataagtatgttatctgactgtagttcaccttaaggaggaaaaaactattaagaaatttcttaagtgtaaattgtgcctaattatgagtaaattagtaacagaagtaaaaaataataactgcagtcaacttatacactttaaaagaatactctgtgaaacaatgacgtgttatcaaaaaagggacacttaatttgttatgtgtggtgatggtcaatgagcagactcgtgttcttgctggagaagtcgcagcatccccacaggtggacttcctgcagcaatcttgtgtgtctcacacttctgtccaaagcatgtaaggggggaactcagtgcgcacaggaacctgacgcctgccatccaagggatgcgtgagcttccgtataagcagaagaagatggaaacttcagcacctgcaacagaagaggctttctgctttggggacccaaacagttccatctatggtggagatgtaggctcattcctacatcaacgtcaacaagccattggacacaacaacatttaggagtagtcgaccgcaccttctccaatgtggcctgcacagcccaggctgcagggtgggagaggtcgattctggagaaaagtcattcctgctcccctggtacactctcctcccccactgcttcatacagggaccaatgtgatgatgccatcatgatgttgaagcacacactgagccctgtaatcaattagagggctttcctatccacccatccacacacacatccacccatccactcacccgtccatccgtccaccacttatccatgcatccatccacccacccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccactcacacatccaaacatccatccactaattcatgcatctgtccacccatccagccatgcattcatccagccatcccacaatccacccacccacccacacatccaaacgtccatccactaattcatgcatctgtccacccatccagctatctgttagcaggagcgaatccatacaggtctgcagcaacttgattctcgcctccttggaggaaagaatttggccaaggggcatacagaagagtgagagacccaagcaagttttagagcaggagtaaatgtttattaaagttttaaagtgggaactaaaggaagtaaagtacacttggaagagggctaagtgggcgacttgagagatctaagtgctctgtccggcccttgacttggggttttatacattgacatggttctgggatttgtatttcttctcccttgattcttcccttggagtgggctgcccacatgtacagtggcctgccagcacttgggaggggctgcatacacagtgggtttaatgaaatgtgcacatgctcatttgaggtgtccttctcttactattagagtgttcctagaggaagattatgtgccagttaaactctgccactttgcctcttagtgcatatgcttgagcccactcacccaatgcctgagatcttatcaggaagctgctgatgaccagtttcgggtgttttctatctattgggagactgccttttcttggcgctggctgagatcaattattatttattattattattattatttgagacagagctttgctctgtcaccaggctggagtgcagtggcacaatctcagctcactgcagcctcttcctcccaggttcaagcaattctcctgcctcagcctcccgagtagctggaactatagatgcacgccaccacgcccagctaatttttgtatttttagtaaagacagggtttcaccatgttggtcaggatggtctcaatctcttgaccttgtgatccgcccacctcagcctcccaaagtgttgggattacagacatgagccaccgcgtccagccgagaccaattattattttagagaggcagtttaacaatcacttgactatcagctcatgcctgcctaactacccactctaatacatccatcccttcacatacccattcatccatccatccatccatccactcacttatctatccaagtactcatccatgcatgtagccacccacctacccacccattcatccactcacccatccatccacccatccatgcatccatcaacctacccatccacccatacatgcatccatctatcttttcactcttccatccacacacctactcagccatccatccatccatctatccatccatccatccatccatccatccatccatccatccatccatccactaatccatggttgggtccatctgtctgtgccacaaacatgcaaagataagttccatgtgacaagtctgaactcagtgttggaatcatgggaggggcaaggtggaacaggctggcttcctcaccactgttaacactgtggggagaaggccgatggcaaactcacttccatgttaaatttcctaaaagaggaaggggagtgtcatgctagagagtaatggaagctcccactgttgacacagaggtaataaatgcctgtctgatgagctaagacctgcaggaacagaaacagtcagccacatgaaaacaaggcaggaaagaggcctatggcagaagagcagctgctgaaagttcccttaggttgggcaaagctgttacgttttgaggaactaagaacagtccaagggcaagccaccgccctgtgtttctcctcttcccctgtgtctgtctgtgttccacagtgattgtgcaaactctaaatacatcgatgacccaccactgcctttatgttagaataaacaaaacagaaaacaaatatctgatgaccccacaggttgccctctttcactttgtatctctcatttctgtgcctctctctctctctctctctctctctctgtctcccttcatctggctcatctctctgtatatctttttgtcttattatttcaacaagggctcttagggtccatctaccgtgctggaaactttcttctcaccaaccattgtaagttggagaatgttttctccaccttattacaaaatgttatagctaattctcttactgcagaataatctttaatatgggtgccctgtttttagaatttaaaattagtatcaattgccattttttcacaattacaattagtattttacaaatgagttttgtaacagggcagggcattaatgaattaaattactctgtaataggaatgagaaattttattttaatatttttgagacagagtcttgctttgtctgtcaggctggagtgcggtggtatgatcttagctcactgcaacctacacctcttgggttcaaacgattatcctgcctcagccccccaagtagctcagactacaggtgcatgccaccatgcccagctaatttttgtatttttggtagatacagcgtttcaccatgttggccaggctggttttgaacttctgacctcaggtgagccacctgcctcggccttccaaagtgctgggatacaggcatgagccactgtgcccagccaagaaattttatttttaatggaccctcttagatagttcttaataatggcagtatcaaaatacatgcaattatgcatatggaagtagcttttttcctacaaacttaagaatatttcaaatcatcttctctctattcttttgaattacatgtgtgagaaacagattataagtatttcatgttattttcccagacatcactataagcatcaagtaactattcacatgtgtgccagcgatttatcatcatactcatgagggttttctatttctagaagttgcccattttttgatctctttttgctttttccttcttgtaaatattggagttcttaattcttttctaatgctgtagatcctcctagggaaggattctctacagtactacatgtgttagaatgtgggtgaaaaattatacgtgctttaaataatgaatgagccccgaaaaaaagagctggaagttgccaggtgctaggaatagacaaaattaaaaagggcatttgaattgagaatgaaacctgaatgcccccttgcatttctgaggtaggtttaacatacacaggacgggagcagccttgtgtgacttgtgggactggagctgaggtttcggcttgagtagagaggttttttttttttttttaaataattagtttctcttttgattgacacataaaaatgacctatatttattctgtacagcataatgttttgtaacatgtctacataggggagtggctccactgagctaattaacatctgtatcactcacctactccccatacggctagagaggttctaagttggcttcagccatgatgtcaggttagaaacattccctcatgaacagcagccctggacatggtagaaaagcaaaccccaagccctcgctgttcacaaagtggtcctagtgtctcacccaccatctggagctgcaaaactgagctgggaaatcactgtcgtggagtgccactggcagcacacaggtcccagcagccaggagcaaggcaccatccacagatgcctgctcccgggggaccacagctcctgtgatgaggtctcatacatagaaaccatgtgatgagcaagggaaaagcgtgtcatgacattctgaaggccacaaagagggaggtaaacctgtagagatgacagatacttcaagttactttctgatttttctaaaattataaaatagatcaacaaaaagctagagaagaatgaataattcaagaacagattttaagaaagaagaactttctgatgtgtgaaagtacccaatatgcattatcataattgtaggcattgagctctcaatgaaagaatgacctcacacttgacactcagaaggggataaataatgttggatagattgccaaagtgttctagaaagaaaataatccatctttaattttacaataccactctttctacaatgatagcgaaaaaaaaatccagatacaaatggcaggaaagtggagcatatagtttcctgctgaagctgctgttgatgaacgtgcctcacttgcatgatctcggctgtgcatagtgtgtggccagtggggagcagtgcttgtgggtggctgaataatgcatcccccaaatgtttacattcaaacccccagaacatgtggtttagtgacctcatatggcacgaggaactttgtagatgtgattaaattaatctcgagaggggagaatatggccctgcattgtctgggtgggtatgatgtaatcacaagggtgcttataagtggaagcaggagaaccagagtcaggggaagggtgatgtgatgatggacacagagatgagaggatggcctttgaagatggaagaaggggacacagagcaaggaatatgggttctagaatctggaaaaggcatgaaaacagaatctccctcccagggttcagaagaaaccagctctgccaacgctttgcctctggactaataaaaccgcaggaccaccaagaaactgctctttcttgcatagaacacagtcagtatgctcacacgacatgggtgggtttgagagttaaaggagactgcaaggtctctggctgaaacagggcaggaatcaggtggagcaagagggtgggtaggcaggacctgattttcaggagtgtaaatgtgaggcactgatgagatttccaggtggagacagagggaggagtcatgtgttcaggtctagagtggagctggtaggttggtctgagcctgagaaaggagggcatcctccaggaattgagagtaggaaaagggaagagtggataagtgctaagaactaagtgggagatttctggaggtggcggctcacagagccagcaatgtcttatggttggggtttgtaaccccagtcactgaaagtgtcctcccagcctctctctgcatatgcccctggggctgagtgcctgcgttggatggtcacttaccattccctaagaggccctaatcacctcctgcagcccagctcctcctggaccctctctctgcatatgcccctggggctgagtgcctgcgttgggtggtcacttaccattccctaagaggccctaagcacctcctgcagcccagctcctcctggaccctctctctgcatatgcccctggggctgagtgcctgcgttgggtggtcacttaccattccctaagaggccctaagcacctcctgcagcccagcccctcctggaccctctggaggggaagtttgtgtttgtgtttggtcacggagcccggctgcagagaaaacaagttttttttttttttttttctaaaggatctcactctgccacccacgctggagtgaggtggtgccatcatagctcactgcaacctcaacctcctggcctcaagccacactcccaccttggcctcccaaagtgttgcgtttacaggtgtgtgccaaggtgcccactcaaaaacgggttcttggctgggcactgtggctcaagcctgtaatcccagcaccttgggggtcaaggtgggtggatcacttgagcccaggagtttgagaccagcctgggcaacagactgtgacatgaccatttagcttatgcaaatgtgggactggttaaacggtctatgtggggctgtcgccttgtctttgcatctgtcactgaggccagaagtcagcagggcagacagttgggaaggaaagacagtgggcaagctgaggtggacagaggcagccacagggatggactgggacacatgaaggcaggcgaaaccatgttgtctctcacaccctttcaagggtctagagggagtcctttaactgattttcttccaatatatgtaattatcaggctggaggtggtgatactggagttcatagcctgactggaagctgtaaaaagcttgtacaaccttatggtgattaatttttatagccttaataagccccagaaataagactaaggcagagacttgatttaggattttgatttttgagaacatttgttatagatgctaaaaggctcaaaatatttgatcaaaacagaatcacaggccattgtaaaatgatagttactaatttaaccgaagtggtaattaaaaagactttggaggcgagtcaagatggctgactagatgcagccaggaggaatatctgccatggagggagtgagacatcaggaagacgggtgctttccaagcagatctttgaaggggaggcattgagagtggattgagagtagacgggggaggacacagatgctgagctgaaggtggaggaagatgggaaccctgcatggggatgccaagcaccaggactcattcctggctcccagcaactcctggggaaaggttgagttgaacaggtgaggagtggcctgctgttgccatgggcctccagaatcctagcagcaggagaccccatgacccccatggacacttgtgctggaagggacagctgcttagagagatgccaggggcaggactccagtctgtgtaaagcccagagtgtttgacatgagaatggctgtagtggagcacagccaggggacacccatcccccaaggctcaccaacctcctctaggagattttaaccttagagtgactatgggacctgaataaagcagggtggtcttgtccatgggacagggcccatctgaaatgagaatttccttgccttctggcctctcctggggccccaggctggctgtgcctgcttgcagtacagccttggaagcccaaccagggtgtttcctgggggccctcatcatagctcctttgccagcagaccatgcctaaccattggagacctccagcaggccagcctctgctgatgtgcaccagtccacccatagtacctcccaactgctttgctggcatgagtgcacagcagatcacaactccctctaccaccagcaagcatgtgcatgtgtgccccaccaccctgtccctgccaacacacgggcacctcactgcgctgtgactgccagcaggaacctatgtagggatgctgccactctgctcctgccagtacccccaccccagcagatgcatgtgcaccctgccatgactccacaactgctggcacccatgagtaagaatggatcccactgccaccactctaatgaagtgctttggccggcaccccctactatagtgttgtggccaatggactgggaacacctcagcccctccaatgcagcaagtttctaaactcaaggggccagagaataaagccaggggcccagtcccagagcagagaacacaccacaagagtgctgaggtgagcctggaccctctaagattttcaagaaacacagctaactgaatccactttataccacaatcaaacctgcaagagtatcaaagaagataagagcaaaaaacaaacaaatgaacaaacaaacaaaaacacacaccaaaaaacaacaaaaaagacaaaaacatccaaaggacagccacttcaaagattaaagaaacagcccacaaagatgagaaagaattaatgcaagaaactctgcaactctaaaatccagagtgtcttcttacctccaaataatcacactggtttcccagcaatggttcttaacctgactgaaatggctgaaatgacagacatagaattcagaatatgcacaggaaagaagatcactgagattcaggagaatgttgaaacccaatccaagggagctaagaaataaagtaaaatgatacagaagctgaaagatgaaatggccattttaagaaagaaccaaactgatttgatagagctaaaaaactcacttcaagaatttcagaatacaattacaagtattaacagcagaatagaccaagctgaggaaagaatcacagagcttaaaaactgattctctgaattaactcagtcagacaaaaataaagaacaaagaataaaaaagaaggcataaaacctcagagaaatgtgcaattatgtaaaaagaccagatctatgacacattggtatcccttaagaagagaaagagaaaaaaagaaacttgaaaaacatttcaggctatcctccatgaaaatttctccaacctcaccagagaggccaacattcaaattcaagaaatgcaaataacctctgcatgatattatacatgacaaccatccctaagacatatagccatcagacatcagactcttaaaggttgaaaggaaaaaaaatattagaggcagctagaaagaaggttcaggtcacatacaaagggaacccaatgaggctaacaatggaggtttcagcagaaactgtacaatccagaagagattgggggcctatattcagcattcttaaagaaaagaaattccaagcaagaatttcatatctagccaaatgaagcttcacaagtgaaggagaaataagatccttttcagacaagcaaatgctaagggtattcatcaccactagattgccttacaagaggcccttaagggattgctaaatatgataatggaagaacgttactggccaccacaaaaacacacttaagtacataacgattgccactataaatcaactatacaatcaaatctgcatattgagcagctaacaacatgataacaggatgaaatatgcacatatcaatattaaccttgaatgtaaatgggctaaatgccccaattaaagggcagagaattgccaagttggagaaagaagcaagacccaaatgtatgctgtcttcaagagacccatctcacatgcaatgacatccccaggctcaaagtaaaaggatggagaaaaatctactaagcaaatggaaaacagaaaaaagcaggtgtttctttttttaaaaatttttttattatactttaagttttagggtacatgtgcacaacgtgcaggtttgttacatatgtatatatgtgccatgttggtgtgctgcacccataaactcatcaattaacattaggtatatctcctaatgctatccctccccactccccccaccccacaacaggccctggtgtgtgatgttccccttcctgtgtccaagtgttctcattgttcaattcccacctatgaatgagaacatgcagtgtttgtctttttgtccttgtgatagtttgctgagaatgatggtttccagcttcatccatgtccctacaaaggacatgaactcatccttttttatggctgcagagtattccatggtgtatatgtgccacattttcttaatccagtctatcattgttggacatatgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccgttctaactggtgtgagatggtatctcattgtggttttgatttgcatttctctgatggctagtgatgatgagcattttttcatgtgtcttttggctccataaatgtcttcttttgagaagtgtctattcatatcctttgcccactttttgatggggttgtttgtttttcttgtaaatttgtttgagttcattgtagattctggatattagccctttgtcagataagtagattgcaaaaattttctcccattctgtaggttgcctgtttactctgatggtagtttcttttgctgtgcagaagctctttagtttaattagatcccatttgtcaattttggcttttgttgtcattgcttttggtgttttagacatgaagtccttgcccatgcctatgtcctgaatggtattgcctaggttttcttctagggtttttatggttttaggtctaacatttaagtctttaatcctcttgaattaatttttgtataatgtgtaaggaagggatccagtttcagctttctacatatggctagccagttttcccagcaccatttattaaatagggaatcgttttcccatttcttgtttttgtcaggtttgccaaaaatcagatagttgtagatatgcggcattatttctgagggctctgttctgttccattggtctgtatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagcagtttttcccaattctgtgaagaaagtcattggtagcttgatggggatgtcattgaatctataaattaccttgggcagtatggccattttcaggatattgatccttcctacccatgagcatggaatgtttttccatttgtttgtatcctcttttatttcattgagcagtggtttgtagttctccttgaagaggtccttcacgtcccttgtaagttggattccaaggtattttattctctttgaagcaattgtgaatgggagttcactcatgatttggctctctgtttgtctgttattgggttatagaaatgcgtgtgatttttgcacattgattttgtatcttgagactttgctgaagttgcttatcagcttaaggagattttgggctgagacgatggggttttctagatatacaatcatgtcatctgcaaacagcgacaatttgacttcctcttttcctaattgaataccctttatttccttctcctgcctgattgccctggccagaacttccaacactatgttgaataggagtggtgagagagggtgtctctgtcttgtgccagctttcaaagggaatgcttgtagtttttgcccattcagtatgatattggctgtgggtttgtcatagatagctcttattattttgagatacgtcccatcaatatctaatttattgagagtttttagcatgaagtgttgttgaattttgtcaaaggccttttctgcatctattgagataatcatgtgttttttgtcgttggttctgtttatatgctggattacgtttattgatttgcgtatgttgaaccagacttgcatcccagggatgaagcccacttgatcatggtggataagctttttgatgtgctgctggattcggtttgccagtattttattgaggatttttgcattgatgttcatcagggttattggcctaaaattctctttttttttgttgtgtctctgccaggctttggtattaggatgatgctggcctcataaaatgagttagggaggattccctctttttctatagattggaatagtttcagaaggaatggtaccagctcctccttgtagctctggtagaattcggctgtgaatccatctgttcctggactttttttggttgttaagctattaattattgcctcaatttcagagcctgttattggtctattcagagattcaacttcttcctggtttagtcttgggatggtgtatgtgtcgagaaatttatccatttcttctagattttctagtttatttccgtagaggtgtttatagtattctctgatggtagtttgtatttctgtgggatcggtggtgatatcccctttatcattttttattgcatctatttgattcttctctcttttcttctttattagtcttgctagtggtctatcaattttgttgatcttttcaaaaaaccagctcctggattcattgattttttgaagggtttttttgtgtctctgtttccttcagttctgctctgatcttagttatgtcttgccttctgctggcttttgaatgtgtttgcacttgcttctctagctcttttaattgtgatgttagggtgtcaattttagatttttcctgctttctcttgtgggcatttagtgctataaatttccctctacactctgctttgaatgtgtcccagagattctggtatgttgtgtctttgttctcactggtttcaaagaacatctttatttctgccttcgtttcattatgtacccagtagtcattcaggagcaggttgttcagtttccatgtagttgagtggttttgagtgagtttcttaatcctgagttctagtttgattgcactgtgctctgagagacagtttgttataatttctgttcttttacatttgctgaggagtgctttacttccatctatgtggtcaattttggaataggtgtggtgtggtgctgaaaagaatgtatattctgttgatttggggtggagagttctgtagatgtctattaggtctgcttggtgcagagccgagttcagttgctggatatccttattaactttctgtctcgttgatctgtctaatgttgacagtggggtgttaaagtctcccattattattgtgtgggaatctaagtctctttgtaggtctccaaggacttgctttatgaatctgggtgctcctgtattggatgcatatatatttaggatagttagctcttcttgttgaattgatccctttaccattatgtaatggtcttcttcgtctcttttgatctttgttggtttaaagtctcttttatcagagactaggattgcaactcctgcctttttttgttttccagttgcttggtagatcttcctccatgcctttattttgagcctatgtgtgtctctgcatgtgagatgggtctcctgaatacagcacactgatgggtcttgactctttatccaatttgccagtctgtgtcttttaattggagcatttagcccatttacattaaaggttaatattgttatgtgtgaatttgatcctgtcattatgatgttagctggttatttggctcgttagttgatgcagtttcttcctcgctttggtggtctttatgatttggcatgtttttgcagtggctggtaccagttgttcctttccatgtttagtgcttccttcaggagctcctgtagggcaggcctggtgatgacaaaatctatcagcatttgtttgtctgtaaaggattttatttctccttcacttatgaagcttagtttggatggatatgaaattctgggttgaaatttcttttctttaagaatgttgaatattggcccccactctcttctggcttgtagagtttctgctgagagatcagctgttagtctgatgggcttccctttgagggtaacccgacctttctctctggctgcccttaatattttttccttcatttcaactttggtgaatctaacaattatgtgtcttggagttgctcttctcgaggagtatctttgtggggttctctgtatttcctgaatttgaatgttggcctgtcttgctaggttggggaagttctgctggataatatactgcagggtgttttccaacttggttccattctccctgtcactttcaggtgcaccaatcagacatagatttggtcttttcacatagtctgatatttcttggagggtttgtttctttctttttacttttttttcctctaaacttctcttctcccttcatttctttcatttgatcttcaatcactgataccctttcttccagttgatcgaatcggctactgaagcttgtgcattcatcacgtagttctcataccatggttttcagctccatcaggtcatttaaggacttctctacactgattattctagttagctactcatctgatcttttttcaaggtttttagcttctttgcaatgggttccaacttcctcctttagctcggagaagtttgatcatctgaaaccttctctcaactcatcaaagtcattctccatccagctttgttccattgctggcgaggagctgcattcctttggagggggagaggcactttgatttttagaattttcagcttttctgccctgttttttccccatctttgtggttttatctaccttttgtctttgataatggtgatgtacagatggggttttcatgtggatgtcctttctgtttgttagttttccttctgacagtcaggaccctcagctgcaggtctgttggagtttgctggaggtctactgcagaccctattttcctgggtatcagcagcagaggctgcagaacagcgaatattgctgaacagcaaatgttgctgcctgataattcctctggaagcttcatctcagaggggcacccagccgtgtaaggtgtcagtctgcccctactggagggtgcctcccagttaggctactcgggggtcagggacccacttgaggaggcagtctgtccattctcagatctcaaagtccatgtgggagaaacactactctcttcaaagctgtcagacagggacatttaagtctgcagaggtttctgctgccttttgttcagctatgccctgcccccagaggtggagtctacagaggcagacaggtctccttgagctgcagtggactccacccagtttgagcttcccagccactttgtttacttactcaagcctcagcaattgtgggcacccctcccccagcctcactgccaccttgcagtttgatctcagactgctgtgctagcaataagcgaggttccgtgggcatgggaacctccaagccaggcataggatataatctcctggtgtgccatttgctaagaccgttggaaaagtgcagtattagggtgggagtgaccggattttccaggtgccgtccatcaccgcttcccttggctaggaacgggaattccctgaccccttgcacttcctgggttaggcaatgcctcgccctgcttcagctcactcttggtgggctgcacccactgtcctgcccccactgtccaacaagcccccgtgagatgaacccagtacctcagttggaaatgcagaaatcacctgtcttctgtgtagctcatgctgggagctgtagactggagctgttcctattcagccattttggaactgccccctcatagattcttgatattagacctttgtcacatgctgatgtggtttggctctgtgtcattaaacaaatctcatctcaaatagtaatccttatgtgtcaaggggtggacctggtgggaggtgactgggtcataggggtggtttcccccatgctgtcctcatgttctcctgatagtgagtgagttctcatgagatctgatggttttatccatgtatggtggttcctccttcattccctctctctctctttctctctctcacctgctgccatgtgtcacatgcctgcttccacttccaccatgattgcaagtttcctgagcctccgaccctaaccacacagcactgtgagtcaattaaacctcttttctttacaaattaaccactttcgggcagttctttatagcactgtggaaacagactaatatagtaaattggtaccaggagtggggaactgctataaagataactcaaaatctggaagcaactttggaactgggtacctcctggcagcggttggaacagtttggagaacttgaaaggagaagggaagatgtgggaaagtttggaacttcctagagacttattgagtggttttgactaaaatgctgatagtgacatgaacagtgaagtccaagctgagctggtcttaggtagtgaggactaaactctgatttttttttcatcttgcccaaattcctatctaaagagtctggggaggcatgctctacaaatcataaattctcatcagatgggttttatttaaacctatatatcatgatttactttccaaactgactctggcataacattatgagacaaataagaaaatcaaaatattttaccccaaaacatgtttctttgccatactctgagatggccctgcaggccgggcatggtggctcatgcctgtaatcccagcactttgggaggctgaggtgggcggatcacctgaggttgggagttcgagaccagcctcaccaacatggagaaaccctgtgtctactaaaaatacagaattagccgggtgtggtggtgcatgcctgtaatcatagctactcgggagactgaggcaggagaattacttgaacccaggaggtggaggttgtggtgagacaagatcgtgccattatactctagcctgggcaacaagagcaaaactccatctaaaaaagaaagaaagaaagaaagaaagaaagaaagaaagaaagaaagaaagaaagaaagaaagaaagggccctgcaaagctgttctttgtgggggaaaatttgcatctgtaaagaatctctattaacatagctagatctttttcttctagaacctcccaatcctaaagagttcaactaagatttgaataggaaacatttgtcacctattatctctaagggcagccactataagacttcaaaagaactttggactctacaatctttatcttaacctgaacattacctttctatctatcccaggtctttagacaaactcaaccaattgtcaaccagaaaatatttaaattcacctatagcctggaagccctagctttgagttgttccacctttctggaccaaaccaatgtgtctcttaaatgtatttgattgatgtctcatgcctctctaaaatgtataaaaccaagcttgatggaattttgtccctgccctagaaatctgtggaactttgcccttgagagagatgatctgaaataggaacttatttttaaaagggaaacagagcataaaagtttggaaaatttgcagcctggccatgtggtagtaaagaaaaacacatttgctagggagaaattcaagttggctgcagaaatttgcataagtaatgaagagatgaatattaataatcaagacaatggggaaaatgtttccagggcatgtcggagatctttgcagcagcccttccaatcacaggcctggaggcctatcagggaaaaatgttttcatgggctgggtccagggcccagcttctctttggagccttgggacttggtgccctgtgtcccagctgctccaggtctagctgtggctaaaaaagtccaatgtacagctcaggccattgcttcagaaagccccaatcattggtggcttctacatgatgttgggcctagggatgtgcggaagagaagagttcagctttgtgatcctccacccagatctcagaggatttatagaaatgactggatgtccagccagaagtctgcgccaggggcaaagccttcatggagagcctctgctagggcagtgcagaagggaaatgtggggttggagcccccacacagagtccccactggagacagtgactaatggggctgtgagaagagggccaccatctttcagaccccagaatggtagatccattaacggcttgcactgtgcacctggaaaagctgcatgcactcaatgagagcagccaggagggctgaactctgcaaagcccatgagagcagccatggggtcagagctgcaaagccacagggtgagagcttcccaaggttgtaggagcccccactttgcataagcatgccctgaatgtgaggaatggagtcaaaggagattattttgaagctttaagatttaatgactgccccactggagtttgggcttgcatgtgacctgaagcccctttattctggctcatttctcccaactgaaatgggagcatgtatctaatgcctgtacccccattttgtcttggaagtaactgacttgtttttcattttacaggttcatagatgaaagggacttgccttgtctccaatgtgactttggatttggacttttgagttaatactgaaatgagttaagatgttgggggactgttgggaaggcatgattggttttgaaatgcaaagaggacatgagatttgggaggggttgggtggcgtgatctggtttggctctgggtctctacccaaatgacaccattcctcagggtgatcagtgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccacatagcattgcctctgaccaaggcactccctttacggctaaagaagtgtggcagtgggctcatgctcatgggattcacttgtcttaccattttccccatcatcctgaagcagctggattgatagaagaatggaatggcctttcaaagtcacaattacaatgtcaactaggctccaatactttgcagggctggggcaaagctctccaaaaggccatgtatgctccaaatcagcatccaatatatggtactctttctcccatagccataattcatggatccaggaatcaaggggtggaagtggaaatggcaccattcaccatcacccctagtgatccactagcaaaatttttgcttcctggtcccatgacattacattctgttggcctagaggtcttagttccagtgggaataatgctgccatcaggagaaacaacaacaattccattaaactggaagtaaagatttccacctggccactttgggcccctcctacctttaagtccacaggctaagaggggagttacagtgttggctgggctgattgacctggactatcaagatgcaatcagtctattactccacaatggaggtaaggaagaatatgtatggaatacaggagatccattagggcgtctcttaacattaccatgccctgtcattaaggtcaacgggaaactacaacagcccaatccaggcaggactacaaatggcccagacccttcaggaatgaaggtttgcatcactccactaggagaaaaaactctacctgctgtgatgcttgctgaaggcaaagggaatacagaatgggtagtagaagaaggtagtcatcaataccagctacaaccacgtgatcagttgcagaaatgaggactgtaattgtcatcagtatttccttcttcttttgttaaaaacatgtttgtgcatgtacacacttgtactaagaaaattccttcatttcttttttcctttatcatgtgacataaaatttattgacttcatatcagcatttaagtgttcttaactttacataatagcatttgggttggggattggtgcatttctggttgtacaaaagatagttgtattacattaggtgtaattatgaccttattattgtctttatttgaagattatgtatgatctcaggagatttgtatgggttcaagttgacaaggggtggacttgtgatggttgatactgagtgtcaacttgattggattgaagcatgcaaagtattgatcctgggtgtgtctgtgagggtgttgccaaaggagattaacatttgagccagtaaactgggaaaggcagacccacccttaatctaggtgggcaccatctaatcagctgccagtgtggccaggatataaagcaggcagaaaaacgtgaaaagactagactggcttagcctcccagcctacatctttctcctgtgctggatgcttcctgccgtcgaacatcagacttcaaattcttcagctttgggactcggactggcttccttgctcctcagcttgcagatggcctactgtgggaccttgtgattgtgagtttaatactcctcaataaactctaatatatatataatatatataatatataatacgtattatatataatatataatacgtattatatattgtatatatacatattaggtttctctagagggacagaactatatatatatatagtttccatagtctgtggtgtagactaggtgaaatggagtttacagcctcctgaagggtaacacccagactctcacctgaattccctgaaatcctgtgccctggggattggagaaaccttaaaaccaaagccactgttaagttagctcagtctttgattgagcatggccatctgcctatacttggcttccagggctgggtgaaggagaattcctgcctggaacaagctcacattacaaagaatcttcacagtgctcatgagacatctcagaccttccatcagaagcattcaggatggcaggagactggacatgatgagcaatatggggataggaggaaggaaacagagaacggaaggaggtgacagctgacaaggccttgtgttctcagatgctgagcatgaaatgaagcatttatgatgagggaaacagaacagatgtacggtacaatattaaatataaagcagtaaattacagcaggtggcttcacagcagcttagacatagcagaagagaagaggatggaattggaagatcgatgctcaggacggatgcagagtgaagccgaggatccgacaaagaggatttgggagatgcaggctttgggagagaaggagggggattggaagaagaaagaatgtttgaaagtactccatagagaaccaggacagcccctggggccaagcagcccatgacccttgcagcttcagaggtccagactccagcctggcctcacatgctggttggtcttatccctgccaggccagaaccctcttcagaacccacttcagaacccagagcccccacagctctccctcaccctatgcccgggacatgtctcccgtgcactcttccctgccccacaggtgggagtttacacctgcttgggtggcctcggcatccacaccaacaacctgttagcagttgtcctgctccctccacctggcacagtgtgaatctcccacagtgcaggccccgtgtttgggagtgattaggacacacaggagggcaggtcaggacaacaggtgctgaggcaggcagatttccaggatttaagtgccgatgctcttggaagaccatttccatggggttaatggtggtttttcttggtgaactgttggcttgtgtttttgatattgctgttgctctaaatagtgttttcctggcttcaatacaaactctattggtcatgttctttgttaaaatacgtatcattctaaaagttcccatggcattagattttttgctcaaactacctataatatttctccaacagagtgcacatttgccttcctttcacacatacctccgccccctgccctgagcagagtcccagtggttcccatctgtttagggggtggggcaggggacacaggccctgacacgaggtggggccgtgccaagcgtggtggtcttgcacgggcactgagtgggtgggccctggagagaggagaggtcattccccctggggaacgccccaggccacaggggagaggtcagctggagcgtgaggtggggggcggagatgcataaagggtgggatggggcctgctgctctatcagcaaaacccctcacacccgaaggacacatagagggagggcactgtattcactgacctcacacttaactgtccattagcgttcagccacaaaataatagaacacactgacagaggcacaggaatggattgctcgcatctttatgacagctgaatggaggaaatttctaacaggttcagagaaaggatatcaagctgtgtttggagaaaggggtgggaattctaaacaatatctatggaagcaggacatctagaaccacagatgtattcagaaaaatgctagatctcagtactaccctagaataccaacagttttctgtggatggtatgggaagggtgatttcttccgtcggtgggctttgcctttgaaattctctctgacatatctacactgcattttaaaagtcaatattagtgtgaattttaagttaaaataaaatgttatctcattcagttatttatacatttaacttccattttcctttacaataactcagtgatacacctagccctgttttccacccggaccagcctgtgctgctacaagcctggtttctcttcctcatcacgacttactcagcttcccttcctgtttcagttcaaggaaatgtgggggcaggaagaaagggggcagctgccactcacagagctcacactaaatgacagacagcttgcccctcacgtctacctatttttctagttgaatttcattgcatgcagcaatcgacctcagggattcattttcccacatacgggaagctcggccccaggtagggggatttgcttggtgggggatttgaacccaagtccctctcactgcaaagcccacagcacccccgtgaggaacagacagggaacagggagtagccctggatcaccctaaactgacttcgggtttagagaaggacagattacctggggaatgaggaagctcattgctctggagctctcttctggagaaatgtcatgaatgttccctgtaaggagctggtggcaacttccgttaattctgggaccagagacctcaggacaagagccagatgctcattcatgtctctccaggcaagaggttctggccaagtttgggctcccagaggagtctaagaaaatgtggaaggcaccaatgtgtgtttttgaagatttatttcagagtgagcatcagcgacctacaagaacctgggacagaagccaatgcctcccgtttccctgtgatgtgaaacaggaccctgtgcttcctgtggacttcaagaaatgtggacttgagctttgccatcccttcccctgatcctgtttcatagattttgctgttatattctctgtatctttacagggatcgggaggctgaattagtgttattcagggttagtaactgtcccttccttaacggtggtggtcctgatagttcgcacatttttggctgtcccaaagagcagtgcaattatgaaggcgtaaatacgaccaaagaccactctcagatacatcactgattgctggctttgtttgacggaacgtgttctttttggaggtggcccgctgttgacactcccaccagcacctcttcttaggcacagtggaggatcccagcctatatggcaatggcagttccttctgttgttgcagactcctctatgaccgcacttctgagggtggcagttgtagcccagtgaagtgatagtcacattgcactgggtgttattacagaagtttccatgaacacaaggagtgccatctatcacacgcccaacatcagtcgtgtctgttgcatggtgttcatccagtccaaaacactgaaaccctcctctcactgagtgatggaatgaaacacgttcctgcagccggggaagatgggtcacattggtacactgcagtcttccacaaaacttatctattcctgcacaagcctggtagctgagatatgtttgttgtctaatacaatgtccaaatcggtagctttcaagatttatgtcatagcagacctcgggagcatcctcagcactgacaccaaagatcgccttgcagagcacattgcgatcagtgcagttcccacgatagcagtagccttcttcagtgcacggggttccatcttgcatataaacgtttgcgggacatgtcacggtggtcccgtgacagtactctggaaggtcacatatattttggataggtctgcagagagtccctggtggggagaagctgcagtttgtacagcactctcctatatggcagatgctccccggtgttaagtgacagtcactttggcagcaataactggcataacactgcttgaaggagccacagtcacattcctccctcccctccactatgaggtttccacagcgaaccgttgtcatggtttcgttatacacaggagcaagtgtttcaaaaacacaccggcctgaatgtataaaacaattttgtgcatgtccataagaacagttactgaacgcatctgtcatcccaggaaatcgctgcataatgcaggaggcccttctctgacatgtgcagtagttatcatcatactccagaccaatacttctcatctgtgtctgggttattatgacggctaccaataaataatgtctgcctggagtaccaatgtgtaacagggctatacgggaacagaagttatacctttcaggttcatagttagattcatgtggcacgtatttaataagtagtgtggatgaatgaacatgaaaagtatcaaaaaaagttgttttaaaataggtaaacattgcactctgaattcgatattcattcacaggggctgggtcacgattattatatatggtcaaaagataaatatagtaccgcagatcaatattttgagcaatgctgtcaatgagactgaacatctggaccacctctttggaacaagttgtaatattgccatatatgcgataatatgaattggaacattgaacgtggccttttatattgcctctatgagaactatacagcgaattagatatcctgggattcatgctgtcatttgcttcagagaacagggggtctgtctcattgtcatcatctctaaatgtgggccctgttgcgttgggctcggccactatctgaaaaacaacatgttcaaacctgcgggaatcctggaggggtttgatttcgtacgcaaggtcgtccagcctcatgatgcctctgaggtccccatagcacgtgtcgacggtgaccatggacagaggcacctcctccaggtagccgaggtactagcagtctggagggatgtaggggtcacccatctgcaagactccttggtcatcctgagttgtcaccagcagatgtctaggccaaagaaggtgtttcctccgcatgtgaatgacgtgtctttgaccccaaaacacaggctgtaggacagccagccgggaaactgaaggcctttgctatggtgtgtctccttcctgggaatcaccacctcggaggaggcatagtgccacaagggacggccttgagaacaccggaccggagccaggagcgcccagagccccagcagcaagaggggggtcctaagggtgacccgcgcctctgcccgcctcatgtcccagcccagcgatagtcatccaaagacaatgggaaaggaaaggactgtcctgggcgaagccaggccccaaccagctgcggtggctgcgtccctcccagggagaccctgacagagaacaaagggcctccccaggctcccgcaccacaccccggggggcacctggactccgggagggaatgaggtaacagtcccagggcggggcagggggtgggcctggacaggacggcagctgctgcactgcgggatgaggctgagggtcatggctgtgaggcctcatcggggagggaaaagggagagggaagcagggctgtctcttttaccaccgtcaatcttttccgtttctttctgaatctacaaaatgcaatgatgtgcgtccaatgccctcgcatcacccgtgttattctcggttgctctgtgggttaatagtgctcctttctgtggctcacactgcttactcctttgtcatgtggaggtagacactgccaatattttccttggggactgaatgtttttctactcttaataagtacccatgtcttattctttttgttgttgtgttgttttgttgtggctttgaagttttgtttgaagttaccagattgtgaaaggaaaatatcttgggccccgtcaagctggaaaccactcaggacaaatctgcctcccagtctatttaaagttgtccctctgctcacagagacaggtgcatatcctcatggcctcctttgcaaacacttatcagaaactcaaaagaatgcaaccatctgtctctcacctacctgtgacctggaagccctaagtggggaggacttgctttgagttgtctcagcctttctggatggaactaatgtccttcttacttatattgactgatgtctcatgtgtccctgaaatgcgtaaatcaagatgtgcccgaccaccttgaatccagagttcctggattcacaagatcaacagttgatatagggtaactttttcttctgtgctatgtaaaactcttgtgaattatgatactttttacttagtccatctattgggaacagatgctattcctgaccccatcagagccccaggtgctgtccctccgatgcttctgtgtggttctctcctggtctttggtcatttcttcagatgcaggagctgatcagctctcagggaagggcacagggggccctctgtgggtgtctcatgtctgagaactaacgtttcacatatttctgccaattctgtcattgcttatgaggggagggaaaatccaaggccagatcataatcagaaacacaaattactgtttcttcaaaagtgtaaatatttccctttcctggcgaatgtggtcactccatttaaacttaacgtgaccgtggtgtgtttcgaaggctgcgctgtgtggcactttgtcttccaacgccccgtactcccatcttccatcgcttcaaatcctgcctttttaccacagatgaacgattactaatgaagctggtttcccctctacgagtgtgcaggttgaacgccctttccctacccctttaaggctttcacagggaacagaaggaaaatatttgacatccctgaaggaggctgctagggaagactgtgttcctcctaaattcttgtgctgaagtcccaacccttggtcctgtccccacatggccccttccctgagatgagctcatctgtcctcttccccaaggtgagcacacctgtccccacgtggacctttccctgagacaagcacacctgtccccacatggacccttccctcagaggagcataactgtccccatgtggacccttccttcagatgaactcacctgtccccacgtggacccttccctccagaggagcacacctgtccccacgtggacccttccctcagaggagcacaccggtccccaagtggacccttccttcagacgagctcacctgtccccacgtggacccttccctcagacgaggtcacttgtccccatgtggacccttccctcagatgagctcacctgtccccacgtggactcttccctcagatgagctcacctgttcccacatggacccttccctgagacaagcacacctgtccccatgtgcacccttccctcagaggagcacacttcttccctgagaaggtggactcttccctgaggcaagaacacctgtccccaggtggaccattctctccgatgtgcacacctgtccccacatgcacccttccctgagagaagcacacctgtccctatgtggaccctttcttgatactagcacacctgtccccacatggacccttccttgagacaagcacacctgtccccacttcaacgcttctctcagatgagcacaactgtccccacctggacccttccctgagacgagctcacctgtccctacttggattcttgccttagacaagcacctctgtccccacgtggacccttccctgagagaagcacacctgtccccaggaggacccttacctcagacaagcatgcctgtccccaggtcaacccttccctcaaaagagctcacctgtccacatgaggacccttccttgagacaagcacttctgtcccctcagacaggctcacctgtccccatgtggacccttccctgagacaagcacacctgtctccatgtggaaccttccttcagacaagcacacctgtccccacatggacccttccctgagacaagcacgcctgtccccatgtagacccttccttcagaggagctctcctgtgctcagacaccaccaggggggctcagacactaatagggtggctcagacactaactgggggctcagacaccatcaggggtcctcagacactaatagggtggctcagacactaagaaggggactcagacaccaccagggggctcagacactagcaggggcactcggacaccaccagggaggatcagacataaggcggggggctcagaaaccaccagaggggctcagacaccaccagagggcgcccagcaaccaagggatgctcagaacctacggaggggcactcaggacctacaggggtcgctcaggacctggctcaggagcagatgcaaagtgaagctgaggtttccgttttctctttggggattccttgtcctgccctgcaaaagccttgctcagcagctattattgtttcttccctggaattccctagttcctctcatctgaaaaggacatagagcagaaatcccatttaacttttcacacttcattttcagtctccttctagcgatatttcagtaaaatattaataagaaataatgaagccacagtccaaatgttagcatcatgcaaagatttgtgtgtcttctccactctgtcagttatgccttaggaaactcttctctcaatccactgctcagtgtacactatgatgttgtgttttgttctttgctttcttctgctttgcagggaaatgaagcaccatttattgggacgtgtcctccatttctgatggactccccgtggtctccacctcagacggttttgccaccatctttaatccgttaatgccttcaatcgacctcaccatccatgtaatgaagcaatgaatgcctttacctcatctacttgtgtctccatgagtcagttcacttctctccattctcacaaaggacagccaacctcaggccactgcttcagagcctcctgcagccttgggtggtcaacctattaaaaagcccctgctgtttagaaaggatgtgtattggaaacttaatcccaaattccatagtgtccagaggtgggaatgttaagaaatgattaggtcatgagggctctgccctcatgaagcaatgaatgccattatcgtcagagtaggttactcattgtggtagcagattagttactacaggcctgggttcctcattaaaaaatgagtttaaacccctttccatccttcgcacctgctctcctgccttccacatggacatcacagcaagaaggctcttgccagatgctaacaccttgatattgacttcccagcctctagagctgcgagaaaataaatttcttttccttatactttagccagtgtgtggtattcactcattgcaccacaaagtggactaagacgaaaaatcagtatcaagaggtggggctgttgcgataacaaataccccaaaatgtagaagtggatgtagtaatgcacaaagactggaataatttggaggatcagactataaaaagtctggattgccctgaatagaacactagaggtgattcttttgaggactcagaagaagagagctgtgaggaaattctgaaacttcttagagattatttaggtgatgaccattagaatgtcagtagaaccgtggacaataaaggccgttctgatgaggtctcaggagaaaaagaagaatagctcatcggaaaatggagcaaaggccatccttgccataaagtggcaaagaacgtggctgaattgtgttcatccctaggtccttctgtaaggtggaagttcagagccatgaacgaggttatatggtgggagaaatttgaaggaaatctatggcctgacttctagcaggcactttaggactctgttcccggtgtccaggcacagcactccttggctgcccatgctgtggctcaggaggacctaggtgtggctcaagccatcactttaatggtacaagtcatcaacttccatggcatccatgtgttgttaattctgcaggtgtgcagaatacaagaaccacgagggcatggctttctccacctagatttcaaagaatgctgtggacggcctaaggtctcgggcagcctaaggacagcctaaggtctcgggcagtgacttgttgcagagacagagtcaccacactgggcccttagcacaatgccaagcagaaatgtgggtttggaggtaccacaaagagtttccagtcagcctaggagagctagaggcctgagagtcccacctgtgagagcggctgagtggactgaacccagaaaatatatagaggcaagactgccggaggccttgggggcccatccccctccccagtgtgcacaagatgccgttaaagaggatgattttccagctataagacttaatgtttttttccctgttgggttttgaactaggcaccgctttctccttgcctctctctgagctttggaatgggaatttctatcccatacctgccccattgttcactgtatttgaaagtagataacttgttttgactttataggctcgcagatggaaacaatttatatcaggctaaattgtgcctcgagtcacactcatatctgatttagatgagactttggacttcagacttttgcactgatgctggataagactttggagacaattgggatggaatgaatgtaatttgcattgtgataaggacataaattttgatattaggaatggaatgctatggtttaaatgtgtctcccaaagtttaggatctggaaataatctttaatgcaacagtgttgagaggtgggacctttattatgtgatcaagtcatgaaggctctgtcctcatgaatggattactgtcactatcaatggagtgggttagttattataggagtgaatttctaataaaagatggtctcttttctctcgtggacaaatggtctcttgctcacccacctctgctgtgagatgaggcagtgagaaggcccttgtgagatgccagtgccttgatattagacttctctgactcaagcaccataaagcataaattccttttctttagaaattgcccagtctctggtattcggttatagtaacaaaaagacagactgagactaagccattgtaacatgtgtgaggtgatatcttatcgtggttttaatttgcatttccctgatgattagtgatgttgagcatttgactctttatgttgagtgaaataagccaggtataaaaaattactccatgatctcacttacacatgcaatctaaaaatgttgaactcagagtagagagtagaatggtgcctaccaggggctggcgtcaggggcatgtgaaagctgagacgttggtgaaagggtacagagttttggttagatagaaggaattcgtttgaagatctattgcacagcatggtgacttccatgatactaatgtactatatacttgaaaactgataagagagtagattttacacgtttacaccataaaaaataagtatgtgaggtgatggacatgtttatttacttgatttaataatttcacaatgcccgcatatgtcaaaacatcacgtcatatccccataatatatgaaatagaatatgtttttctagtaagtgtgatgcctctgtttctttttctttcttttttttttttgggaacaaaacaataaacacctttattacatgggtgaagacaaaacaaggatttatttgcctttctgggccttgattttcctaagatagaactccaactctttgccctctagcacatagccatctgctcggccacactgtcccggccttgaagccatgcacgcaagaagcttgccctgctggaactgctcccccaggagactgctcattttggcattcttcttcctttcatcatatttcttctgaatttttttagatcgttttttgtttaaaatctcttcttcctcaggagtcagcttggctcccttcttgcggcccaggggcagtgcacagtgggactcgtaccactgtcggtagggcgtgctgtcgatgggcacgatgcaattcttcaccacggtcttggtacgaaccagctcgttattggatgcattgtagacaacatcgatgacccttgtttcaccagcgcagcattctgagccccaggagaaattccccacgtccagcctcggggcacagtatttcttgttacctcctcgcacacggactgtgtggatgcggcacgggtcagtcttgctgttggcagctgggcgccccaactcatacttccgcttcttgtggcagggccttctcttgcccccagctttgcggcccttgtgccagttgtcccgagaggtgcccatcgctcggcgctggctggaaagagggcctctgtttctttaacaatactttctggagattgtttttcccttgagcaatgtttcctctctgctgtatttacacagttttcctttcccatgggttgatttaagacagtgacaatttatttattctatgtctggtaatttcactgagaaacttaatgaatagccacttgaaaccatctggtgccactgagaaaccatctgaaggacacagattttctgagtgtaggccacaaccatattttaacactttttaaattcaaaatcggggtttaaattttgatattttactatggcttctttgattccctcccaagatctaaccattgagcgtgtgaaaagggctgggacccaggttacggctgtgcttggcatgatgacgtcctgcagaaattcctttggctttctacatggagctcagcctccatatcagccagctcaccaggaggtcagagtacttttcaaagatcctcattgtgttgtttcattgtgagaggtttccagccctcgtgagacaccccttggttttacagtcatcacgaacttgtttacgattccgaaaacatacctgccatctgtccatatgtttgttctgcggcttttgatttgctaaaatgctgtagtaactgcaataagttctaccatctggattaattttcacctcagatggaagagtatattttaagataaagataaaatagtaatagtatatcctccttggtagtatccagttctatactttgagctatggtctgtcaataaataatgttatgccagggtcctcaatggagtgcctgaacatctaaggaaggtacagaagtttccctaactaagatagaaaccatggtgagcacaagtttgctatgcatccatgtctccggtctgtctcactatgcacctgacactcattttaacctcaccaggaagtcagttaacttccaaatcagtttattgtaatgcttccaggtaattatatgtggcaatttcaggcagaaatgaataaaaatcttcaccagagaatctaatacagaagaatgcaagaggccctgggcttgttttcataaaagcatcatacaccaggcagttgattctttcagctgttggcactggctcacccagcatgcgggcttcatcccctaagtaagcttcatcatgcatggataggctggcgcctttcctgaggccatatgccgatggatatgcagcactgtgccacacgtccacagagatacaaaatccctgatgggaagaacgaggctggatcaacgggactggcagtttctcattgaggaaatgtgaggtcagtttctatggtgggcaattcaggaaattactcagcagttttgtaattgatggttatggaaaaatgaaccgttgagatgactaatgacttacattccattattccaagtaagaaacggacatcacagttcgctgtaactaaattttcataaccaaatggattactttaaatttcttcctacatcttctcttaataatttttaataacgaatgtgtcttacctatattcccaatatttaaaactgggttgtccagagagtctagagaatttgagaactaggaacagtgaaactcctgtatgttcagcagctcccaaagcaacacaatattccccaggaacactgttctgtcctccagcataattcatgcttgtgtatttcctaatggctccaatagtgaccctccattcccaccaaacatttggcctcccctctctccacttcccctccattcatacattacactctcagctctgtctagggtgtcataaaagccagcggacggaccctcctgatctcctgaacatgaaagccagcactatcatgtgatgggctcctcttggcatggtgaccttcaaaggcacctcatttaaataatcaccttttttttccttctgtaacaaagtgtttctttccattgtgccttcccataagcagtttaacataatttactgtccgaccacagttattaatacacacaaatgccacaacctctttttagcccaagagacctgattaattcttctttggggatgagcacaccctagaaacacatcccattcagataaacacgggcacaccgatgacgtgttcttgagtctacaccattctccgtccaactccatgagcccctgaagaccaagacaggctctttcacacctgtgcaagctccggcccagggacggcctgctgaggaatgggctcagctgggtctgggtgctgggttcatctcttcccctctcctgtcccaaagcaggtccatcaccctgctcaggtctgaacaggagtgtctaggtttttctggccatccgactttttcaatgtatagaagctctcctattacctactgtattcattttatagggcttttataacgaaataccacagatcggatggcttacaatacaaaaccaatttcctcacacttatggaggatgaaagcctaagatcaagctgccagctgggtgggtttcctctgaggtctcgctccctggcatgcagatggcgccttctcactgttctgtggtaacatggccgtccctcggggcctgtgcaccctccctcctgcttcctcttcttataacaacagtcagattgcattagggccccactccaggaatctcactttaacttattcacctctttaaaggacactaatccaagtatgatttcattctgaaggaccaagggttgggacttcagcacatgaatttaggagggacacagtctcccctagcagcctccttcagggatgtcaaataaaaggaataaaaggacactgatgctccagaaggccttgagagtttgcagctgctttgttgtggtgggacgtgggtaggcctgcaccttatctatgatggcagatggaatgactttagttttacccaaccagatgacaccaactatttgactgataagcctggaccctggattttgtctgtattaacctcccatcctctattcagcaagtgagacagcaagacaggggctgtaatttataagctgaaaaaagactcagaggttatcatgataacaccaatgtagtggaaaacatgtatcccctttgggtcagcccatcgactgaggttggaggtcactaggctgtgagatttgggctgtgtaaatatccctggaacaagacagtaaaagtccattgttctttttaggttaatgcaaattgatcttgactctggggcaacagaaatgctgaagaaggtattgactaaactgataaggaaatgctacgtggctaacacctctcctattctcgtcagactggaggagatattaggaacagctgcattcactcgggagaccaccttatttaactcccagtaatctactgtcattctccatgtctcaactggcctctgcatgggccatgcaggtctgttgtaggaaccatgcagtggcctcctaatgcctacctgggctagctccttaacaatcttcatgattggatcatcttcccctcccagggcgggtggtgttgctccagctgtgggactccccatgggttggcagctctactggcatccagtttgccttctgcttggtcacacatatcaccactctaactctccgttggaattccctggccgttgtttggagggtcacgcctaagaagatatccattctcatgtgttctaggatggaagctgtgtatactacacagggtctgggtggcagtcccccaggtcgtatcactagttcaaccggtctgacttccgtggcccttccataaccacctattgccgctatgggcccagagaactggtaggtgttgccagttagagcacattcgttgtctggccaccctgactggctccttggctgtctctcttcctttggtgccattgttcttcatcacagtagggtgcatcccttgcttactcagtttcttcttttctcctaagtcagcaactacctggggcacatgaaatgttggctgccctcccagggggcttaacgtggaaatcagtgcaccatgccattgggtaggcactgaatacataactgtagcttttattttgcagtaaacaattcattgttgggacttcaataattctcagcataattagcatgcctcatctcgactcccagaagatatcctgcaactcttctatagtctgccattgagaacgagctgtgggggcatcttcctcattggacccggcccccttggagcctgcaaccacttaccataaaggtgccatcatagggctggatggtttgtgatgggtgtcattttactcatcttgagtccagagagtataatactctccaccccctatcccatagagaagccaccctgtgatccactctctccccttgtgtctgaatccaattctaagctcccccaattccacagtggtggaattccgcattgtggtgcactgccttctcttaggtgggggaaagttctgtggggctaacttctgctggcacagttggcccacttttatgttggtggtgaccaccacaagtaccatttggctacagactgtgtcctggcattccaaggcttttgtgtctggaaggcatcctttagccagcctgctaaaggttgttccggatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaaggatgtttcccagcacttcctccaagaaggaaatttgtgtgattaccccatatcccggctggccctgtgacttgcttctttcaaacttcttggcctggaaagtgcaggcaccagctgttactgtcacccctgttgtgacactgtacacagcaccagggcaggagcctggggatggggctgaggagagacactagctaggtgaatccattgaaaacttggggacctgctggggttcccactctgagaagcacagatcctagagggtttggaggaggaggaagtcaccatcagtgactcaggagctgctgctctgcaggtcacctgattggcaggtagcagtggcaggtgagtgtgcttcatccctacagggacacgaggcttcgacctgcccctcctcaccaggaaggaaactggctttattcatcccggtttccccagctgtctggtcatcctctcttcctgacctcctgcccagggccctcaggcctgtgatgcatggacaaaggcactttctactccggtcgttgattccccaagccagctccctctagaaaatgcatgatgtcttcctggttctctgtccctggctgaaccagagaggacacacatggatataccaaagtgtcaaagtggaggagaggaatcttggaaagcagtctggagagaggctgcggagaacaggaaacacttgtacagtgttgggtggaatgtgaattagtccaagcactgtggaaagcagtctggagatttgaaaagtatttgaagcagagctgccacttggcccggccatctcatatgtgggtatatgcacaaaagaaaataaatcagtctaccaaaaaatacacccacttacatgttcattgctatgctactcttaatacctaagacataaatccaacctatgtgtccattcatggtgaatttgatcaagaaaatatggtacatgtatacaatggaacactatgcattcacagaaaaagaataaaatcatgtcttttgtggcaacatggatgcagctggaagtcaacattctaagcaagctgatgaagaacgagatgatgagagtcaacgggagatgaagctgacgttttgggtttgcctgtgtgtaaaatggagaaaagaaatcacctgggcacatagactcttaaaatagccaagtctggagccactcatatcccagtttccatttcattaggttttaatctttgtcatttttagcgagttaaatttggttttctttactcttggctaaaataaccacacgtcctgaattagaggcattgcaatcaaaaggtcatatttgaagcttacaagtcccaagtcaggtcaaagttagtgtgggattcagtgtgatagataggagacatggctggatactaagaatgggctcagggttattttacctaagttaggaaaattttttgacatcccttctgttagatttcattggaaacctttgttctaataccatctctgatagattatacctcaataattaagctggaggttatgaattagtaatttaaattaatagtggaagcctccatctagaatatatttctctaccaagtgtaaagttagctcagacggcagaaataactgcactcagcagagcttgtcagtaaggcaaagacatacacaaacacatttattgcaagggtagtgcatgacttggaagtgatccacacacaaaggattctcgcattgtctagaacacgtcaaaatggacaagggaagggattgtaaatgcactcctaagtcctggagacctgactaacataacataggaagaaaaggcaaagaaaaaagtagcataataactaaaatacatctgtaactctatctatctatgtatttatgtttgcaactatatctctatcgaggtacgtatgtatgtatgtatgtagccatctatcatctatctatttaaagcaagcagccctaaaattgtttgtaatactatctaaaaatggaaggaactacaatcactcatataacacagaataatactgtctacagctttctggaaatgttgaaaaaattgtaacccttaaattaaaattttcaaaactttaagaaaatctcggctgggtgtggtggctcacgctgtaataccagcacttcgggaggccaaggcaggaggaccacttgaggtcaggagtgcgagatcatcctggccagcatggcaaaaccccgtctctactaaaaatatgaaaaacttagctgggtgtggtggcacatgcctgtaatatcagcttttgggaggccgaggcaggaatcgcttgaatcagggagacagaggtcacagtgagtcgagatcgcaccaccgcactctagcctgggcaacagagtgagactctgtctcaaacaacaacaacaaaaaaaaaaaaaaaaaaaaaaaaaaaggaaaaggaaaagaaaatcttggacttccttggccaaagtttctccccgtggtgttacggtattatagtcagctcctccagagtatgtccgttattacactattatttggtggctgaaagatcgtacctttagagactttacactcagtgctcaccgctgtcttattgcatgcatgcatgtgttacaaaatattgaaagtgatttctgtattataccaactccattcaccaacagattaaggctactttggtacttcatcttttcaacagtctctcatgtgtctattgcaaataaagtcatgagaaaatactgctcttgaacctcatttcaaggactcttgccaagtacttttagccaaaacaaaggagtgacttttagaatgtcaatacttaggtccatatttataaactttaaactaaaagtaaaatttcagtcaccccatgagattgagtggttccccctcttggccaaggaggcaccaaaaacacctaaaaactgagttcccagctgggcagaacaagagatcagacacacctcattatacccactcccttttgtggttcagagacaacatggaccaacactaacattaaaatggagatcataagactgacagaacagattctccggggcaataagatgccccgttataaacaagacctaaggccatgccaggcaggggttacatccctcaccccaactcttaaagaataaactgttattttcttctgtagcagcaaaataagcactgatcctgagataagcacgatttaaccaactgcagctcatcccctgactaactgaccccccattccacagccataaccccagcttggatgggacaccagattgatttcaggaattttctcctgatcagagaccactgaccatggcctggttctggccatttatggaggctgcgctctgagggtctttgtgcccctgctccagcttttggcacttagggcctaactgtaacacatttaaatgctaagtccccactgctaagtgggtcacatgtgacgtgtatgtttgctcccatattcatgtgtcatgaccacctttatgaacacgcatagcccctcctgtaatccgttgattatgtctgtttagccaacacgttcagcataaagtttctgccccaccgctcctccttgggagtgcctgtctctcgtcttcaccaatggctgtgcttcccagcctgtgaaatggctgtaatcttttataaaaagtaaaggcttattttttaaaatttgtagattgtgtgatttttcatgtaatgcaaccgaggaattaattcataaacccacccagttgtaaggctgctcaagtacgaaggggagacctgcccctccacacctgtgggtattcctcgtcaggtgggatgagagactgagaaaagaaataagacacagaaacaaagtatagagaaacaacagtgggcccagggaaccggcactcagcataccaaggacctgcaccagcactggtctctgagttccctcagtttttattgattattattttcattatttcagcaaaaaggaatgtagtaggagaccagggtgataataaggagaaggtcagcaaaaaacatgtgagcaaaagaatctatgtcgtaattaagttcaagggaaggtactatgcctggacatgcacgtaggccagatttatgtttctctccgcccaaacatctcagcggcataaagaataacaaggcagcattactgcaaatatgtctcgcctcccaccataaggtggtttttctcctatctcaaaattgaacaaatgtacaatcgggttttataccaagacattcagttcccaggggcaggcaggagacagtggccttcctctatctcaactgcaagaggctttcctcttttactaaccctcctcagcacagaccctttacgggagtcaggctgggggacggtcaggtctttctcatcccacgaggccatatctcagactatcacatggggagaaaccttggacaataccccgccttcaagggcagaggtccctgcggctttccacagtgcactgtgcccctggtttattgagagtagacaatgcggatgacctttatcaagtatactgcttgtaaacattttgttaacaaggcacgtcctgcacagccctagatcccttaaaccttgattttatacaacacatgtttttgtgagctccaggttggctcaaagtggctgggtcaaaatggctggggcaaagctacaaattaacaacatctcagcaaagcaattgtttaaagtacaggtctttttcaaaatggagtctcttatgtcttccctttctatatagacacagtgacagtctgatttctctttcttttccctagtgaaggacaccaagctgagcattcccatgtatcctgtaaggcctgagatatattgaagaaggacttgacccgagaccctcagagcaagctgatgatctcacagagtgaagagcttccacccaggacattggtccaagatccctgttcaatttgttcttctctttctttttgttatgtgcttacacttaaaaaaactctattttctgcagacctatttgctgtccacccagagtgaacacttacctcatttttcactcatttgcttaagttgctaagtagaataagtcatcagactctattttgatgcctcattactgatgacaggattaatccttttccttcacttttgtcccccacacatgggaaatttagtagaaaatcatggaagtgtcctcactggatgccagtattaggttcaaattatacaagctccttccccttagtaggaagccccaccattccttcaacaccaaaccatcataaaaaccctgaggcagcttctttcctgctctattgagccagtttggactttattgagaggcctgtgcagccctcagcagacgcctcaataatggagttggtaaatctttccatattcacgtggtgtgtgaatgtggcaccatcagactcgacatccacactaaacattggtgagggtatctcttcctttgcatggggtcacctgcaattggagctgtgagcttgggtcctgacagtgaccaccacgggcactttcttctcttgcactggatactaactccttccgccccagtgtctggcatgcaccgtatcctgcctgctgcttgctggccctttcagtgctgtcatgctgggctgcagtgttgagttaaacaaagtgtcttttatagatttagctgatttacttcagaagcattgataattgacatttaaagacaagattaagcgactgtaggaaactgtcttttacacatgtgagaagatttttcttttattaaaacaaacattttcatttcagagactttggagataagcaaaaaatcatgaattcagataaattcctcaagggaagatgttttatggagaagaagccacagtgctgacgggaaagaagagctcagcctccatctgcacctgcccctgaggctggctcttgtgatcagcgtgtcctgagcacccctggggttagaatcctgtgctcacttcagtgaggtttgtgtctggactcaaactcactttccctctattttttcctccaaattagagaaattgtaagtcatggatcagtgcaggtcagagaacaccaaatagcaggataagcccttaacacacacacacacgacacacacatacccacacacacacaaacactcttaggtgaatcatattcaaattactaaaacatacagacaaatggaaatacatgccagcaattggagacgagtagagggggcataccttgcaatagaatagaaatgaataatatcagcattgctttggttataaccatataagcaataggacaattgatggtatctgtaaagtgttgggaaaaaagtcaacccattattttataaccagtgaaggaaacagttccacatctcacatgacggtataaggagctcgatatatccatgcctccatgaaactggtgagattaattttgaaaaattaacgggtctggaaaggccctgtcaacatacagaaagtgaaggaacatttattcgagataatctacaaaacctcagtaaggtcagacatgatattgatatttgatcaaagattctcttccttccttctatgcccgagctcagcatgatgtaaattccaccacagatggctgcagccaagtagacaggattccttctgcccagctcccagcagagcacactcttccccaggggccaggacattggccctccgaccttgcccacaggtcatgctgctgaggctcagttctagacaagacttactgagaaccagagactcacttcttccacacagccccactcatggatgcaggctctgccctgagtgcagcaccaaggaggaggacattggctgcctggttcccagccctgctcctatggcagagggtccaccccagcaggatctgcatgctggtaaagtggaaagctcctccccatccctccactgagcactcatctcctacattgaggaagaaaaacgctcttaatctccacctgcagaatcttatttaggagctctgtctcaggagtgggggtgaggctgaaatttggtcataaaatagagtcccgaatctggtctcgaaggacctgacttcatttacaacagagtgtggagaattacaaaaacagtggaggctgtggtaaaatgcacttgggaggagatgggtagatgcatgagaggtccaggctaaactgcagggctgctggcctgcaggagagaaccaagaagaaagagagcgggaagagttctcctggggtcagtacaaatgtcaggcactgtttgttcaaaggcgcccatgtttgtttggttcagtctgtagagcaacttagccctcagtgcattgttgaaaatataaacttccaactgcaggtagtggagctcaacatctggtcctggtcagggaagagccagagagagcccagcccaagccagtgacatgtgagggtgacagtgaaatccatgactgtgtctctggggatctttcaggcaggccttctgtcactcagaagaaagtctggagttcacctgtaatggtttgtgtcaaattttcaaagatgttcatgttgtttttagtttctaacacacacacacacacaccacacacacacacacacaatgttaaacatctgaatacgtgtgtgtgtgaacacatgattttaatcctttgtaggacatactcagggatgagagttctaggtcatggattaaggacatgtttaattttataagaaactgtaaacagttctcccagaaactctttcattttgcactagcaatattttagtctctcggggcctggcatgctcactgacactggtactgtcagtatttcttctttatttttcctcattctaaagcctaaagtcgtgtctccttttggtcttgatttgaatttctctactggaaaattacattcatatgctgatgtgtcatctgtacatcttctttgatagaaagtttgcacaaacctttgcctattttataaacagattgcttctttttactgttgagttttgagggttcttattataattacattgttagatgtatgatttgcaaatactttctcccctgaagcttgtccttcagtttcttgatagtcggttgaatagaaaatgttttaaaatttgatgaagttcaactaaaattattttcatttattgcatcacacgttttaattttcaggattgttgatcaactgttaataatttcacatttcaattgtatttttttttattttattcgtatacatttacggggagtgactgcaattttgttacatatatatattgcatagtcgtcttggctttaatgtatccatgatccaaataatgtacatcataccctttaagtaatttctcaccattctcccaacttctgctctcccatgtttctgagtctgcaatgtccatcattcctttctctatgggcctgtgcacatattacttagctcccatttataagtgaaaaagtgtggtgtgtgctgttctacttctcgtttattagacttaaaataatgacccagagttccatccatgtagctgcaaaatacatgattccattccttaatatggctggatagtatttaattgtatatatatgtgactttttaaataaaattatctgttgtaagacacaggttaattccttaggttgatatctatgctactgtgaatagttctgcaggaaaacaaaagtttggttatcattctgatatgatgatttatttttcctttgggtagttacccaatggtggggtcattgaatcaaaggtagttctgcttttatttctttgaaaaatctccacattgttttccatagaggctgtgctcatctacatcctcaccaacaatgactgagacttccctttgcctttgatcgccaccgatgtctgctatttttgcttcttttatagtagccattctgactggtgtaagatacctctttgcagttttaatttgcatatccctgataatcagtgatgtttagcacttgtccagttatatgtgttctttaaaaaaattcctactcgtgtcctttgccaatttttaatgaggttatttgttttttcatagctgttgttgtggtggggttgtttcagttccgtgtaaattctgcctatcagtcccctgccagatgcaatgtgtgcaaatattttttagcattctgcaatttgtctgttcactctgttgctgtgtggaagctctttagtttaactaaattccattcatctatttttgatgttattgcttgtgcttttgaggtttttgtggtaaattatttactaagcccaatgtccagaggagttctcctggtgttttcttcgagtacatttatattttgaagtcctataatcaagccttcagtccattttcttatggttatgtatatgtcgacaggttggtgtccagtttcattcttctgcatatggcagtccaattgtcccagcaacatggcatgaagagcgtggcctcttccccgtgcatatttttgttgactttgtcaaagatcacttgaccatagattgtgtggctcagttctgggttttgtacaacgtacctgagagccttgattctccggggatttcagcactgacctgctcactgctggaactctgttagctcagtaccttttgagtgtagtgacttgttgccatgggatggttttcctaaaattgtagacagttatgtttcatgttgaaacgtgagctaggattttcataagaaaggtattgttgaattttccatttcttttccacattgctcctcagactcactgacgtgggtttctgatgtcaagttgaggcactccctttctaagagctggatttttaattacatgggtatttatgggctccctgtgtggaaataagccttgtctatcacacctaccctacgacatttttagaaatttatttctgcactgttactgtgagacactccgtgatggggacacattccatctgttttattgttttataaaattattttattaacgcacctttctctctacgagaaaagctattatctgaattttcacaattcctcctgctcccttatccccacatttttctccagtgtcatttcctgcagtttaataaaggcatatgttctgctgttttgtattcggccgcttggagtagtatgagcccattaaactggcggccacataccagtgatgcatctggcccaggtaacatgaacatttcatgctgaatgtttgacaaacaggactcagcttctgcttctatgaactattaacaggagtcatgccatttattattaaagaagaaggaggaagacagggctctgagtctaatggggatgggaaatgcaggccctggcaggaaaacgtatctcagctgcactttcctgttctgcagaggtggggagggagcaccaatgagaagcagcctgggtttttgtacaggaggtgccctgggctgtgtctttgtggtctgtgtgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagacccctgtggagaaagcataagaagatgaagcccacaaacaagaaaactgatgtttcacccgtgaaggagtccctgaccacagcactcacatgaagggatggtcagcagcaggagcgtggagcaaagtgtgtccatggtggggcacaggagtcactgagctgggacctgtgctcggctttttcaacccagaggagggtggagctggtggagatttgcattcccctcatctgtgccctactctatgggatggagtcaggtttcaggactcaggagggtgttgcatctgtggtgaggaccagtgatagtaacatgatcagtgtaattcagatggcattaatctaaggctgggcaagtagattctgagtagaagtctttgcagaagtcatgattatgaggtcatgttggtctttttgcaagaactattttatgatagttcttgttgtcagggatatgtgtgtaagaattctccctacacttcctgaatccatttgtcagggttttaacatatgtgactccattttgattcttacaaatttcacaatctcatcctaaaagcactggtggagaaggacagtttatgtagcagccaattaactctacatccacctcccattttaaccagacaaacatatttctttcactacaaatggccacttgcatttccagagaagcctatacacaatacagtggatggtcctgagcaaggagagtgaagaaagtcccttcagcctcttccacatggctgcagtagccacagcctgagccccagctgagctacagggaaagggcttcagcccttgaattgaggtcacggagaccacatttaccttttccagggagcaggaaaatccaaaggaaaagtgagaacgacaactaaaaataaaataaattagaatcaaaagaagcaccagatcagtgttattaatttgcataatttagtgtcaggagaagggtcagacaaaaaacttgtgagggtccccatattctatatgacactgaccatggtctaccatctttaggctgttatcaccatccttaatgactactctaagggagacccactaaggtctctgttctgagtgtgattggagaagactcaacaggtcccagtgagcttctacatgtctccaattttggtgactatggttgagggcttttcatctctgtgtcaatttgtgttttgtccatgtgagagtatgtcctccaaacacaatattttaaaaaaatatttggagatgtcattggtaggcacagaattctaaaattacagaagttccttggagaaactgtcagacggagtttttttcttcttttttcaatgcttgcaggaaagcagtcctaacctttgcactcccctctgtggttgactgatcagtgggtcctgagcgccccctgcagctcattagcccaggtgttcctggaggtttgtgtctcacaccggcctttcctcatgtgcttctcttgcacagtaatgtagtgacgtgtccttggtttgcagattgcccatttgcagaaacagcatcttcttgacattgtctcttgagatgataaatcaaagacaaataaatactctgtcggacaaacaaatcctgagaaaatctattcccagcatattaatcttgccatagacgttttagcagagtttctagatgagcagccatatgatatacatccaatacctgaatgtatccaaaagataaagattgtcaacaatgaaaaaaatgaggtttaaatttagtttttgcatttgtgttttctttattacataaatgtgtaaagcaattataaaaatgtcaatattacatttttatagcttatgtaattacaaactgataaaataaaaaagggatagaaaagaggaattagacatatatagttataatatctctgttctatatataaaggggtaggctgggcacggtggctcatgcctgtaatcccagtactttgggaggccaggtcaggcagatcacaagtcagaagatagagaccatcctggctaacacggtgaaagcctgtctctactaaagatacaaaaaattatccgggcatggtggcaggtgcctgtagtcccagctacttgggaggctgaggcaggagaatggcgagaacccaggaggcagagcttacagtgatctgagattgtcccactgcactccagcctgggcgacagagtgagactccgtctcaaagaaataagaaagagaaagaagtactacatttttgaattagaattcaattatagaaatgtcttattgttatccttatggtaaccaataagatattcatcaataataattaaataataaattaatagaaacaatacatattattgtaaaaagacaaaacaaccattattggacaaaagggtaatatcattaaaaaataattcctcatagttgactaaaaaaaaaaaagacccagcaattatctttctccaagaaaacttcttaacatattcacaaagagaagaaataagatggaaaaatatagaccatgaaaatataaaccaaagaaaacttgaatagctatgttaatttcagacaaaataatcataaaaagaatacctttgcaactcaagtgaaatattgcataaaataataggatcaacttttccaaaatccattttaaaagacctaataaatggatttggaacagaaaatagactaacatgtatagaacatggagaaatcaacactcattgtgattgagaaaacaagcaatgattaaataggtaaagatataagagtcccaaatggcactatcaacctacttgataaatttttatctataaaatattcaactagaaaacttcagaaatacaaactgtcatttaccagaagagaataaaggaacaagacaactgaattcaaactgatggccttgatggaatctggaaacaaacaaatatacgaaagcaacagcaaagagagattctgtcccaaaaaaaagaaaagaagatatccactaaaagggacaaactatgaaatatttaaaatggctcattctgagatatatatgagttaccaaggcccatgacacgaccccaggaattcctgagaacacatgtccaaaatggcttgattacagcttgattttatatactttagtgggtcagaagttacaggcagatattaatcaacacatgtgagctataccatttatgcagtctagaaaggcaggaaagtttatgcacagggttccaggacataggagaattcaaagattttctgattggcaattggttgaaatgtaaggtaatacaatcattacaactgagtgtctggattaagataaggggtcctggagatcatagttcttattatgtagatgaagcctccaggtagcagatttcatacagaataaatcattaggttttgctatttgtcatgtgatgctatactagaatcaagttgtaatttgatgtctttttgctatagaaagtgtttacagcaaaaatatagttttgcccgtcttaagatctttgttgtagtactaatgctggccactggtgccttaattccaaagagaggagcatgtaatgaggcatgtctgacctctcactttcccatcattgctggaacaagttttagaatttactttgaaattcccttggctgagggttgagttcatttagttgcttgaggaagcttagaattttatttttcatttacaatagaaattattggaaaaatgataaataaaataaggtctggtattgaatatatttacacttatcaatgtaaatgtgttaacaccatgtcttatgatgatagaggatattcatcttaggagatacttggagatgggaacacactgtattaactttataatttttttatctataattattctgaatcaaaagtatataaatgtaaaaagtctatcataaaaatacaagtcacaactgataaaataagtttctgaaaattatacaatttcaattacatttatgaacatgtattctggaagaaaatattgaaattaccatcaaaaaatgaccaatgtttatttgtataaaaaacatttgaagcaccaaatactaaaatcaagcaaagagagtgctatttatatagttattttattttctataatatgatttaaaaagtgttattataggcattttataaaccagtagtgagcataattatgttaattttttctcaattttgtgtcaatatcttcttaatttcatatagacatttgttactgcatgtgtcatttccaaaatattcagctattatttttcatattaatatgactcctttgttggccctaggcattgcattttaatatggacatttatcagttcccaaaattaatacttttataatttcttacacctgtctttactggaatctctaaacataaattgtgaagatttcattttaatatggacatttatcagttcccaaaatcaatactttcataatttctttaatctcataatcctgttatctttgtaagctgaggatgtaagtcacctcaggaccctgtgatgattgcattaactgtacaaattgattgtaaaacatgtgtgtttgaacaatatgaaatctgattgtaaaacatgtgtgtttgaacaatatgaaatcagtgcaccttgaaaaagaacagaacaacagcgattttaggaaacaagggaagataaccataaggtctgactgcctgcggggtcgggcagaatagagccatatttttcttcttgcagagagcttataaactgatgtgcaagtagggaagatatcactaaattctttcccagcaaggaatattagtaattaataccctggggaaggaatatgtgatctttgccctgctttttgccccttaaagcatgtgatctttgtgacctactccctgttcgtacaccccctctccttttaaaatccctaataaaaacttgctggtgttgcggctcagggggcatcacggacctatcaatatgtgatgtcacccccggtggcccagctgtaacattcctttctttgtactctttctctttatttctcagaccagccgacacttacagaaaatagaaagaccctacattgaaatattgggggtgggttcccccgataaatcacctgaggtcaggaagtcgagaccagcctgtccaacatggtgaaaccccatctctacaaaagatacaaaaaaagaaaatacaaaaatgaacacatatccaaatatcaaaccaaaacatgaatttatttaatgttattttaattatataattgaatcgaatgtactattttatagtataatgtaatattccaaaatgttgttgctctgtgtgattgtttcactatcctaatgccaattaacaaacatatttaaaggcaaggtttggtagaaatgaaaataaatgccattcttgccaaattaattaatgtacaatggtatttatgtataatcgctgtgttggtttgtttgtcatttatgctgttagtatactttaaaataccaattattaatacatctaataacaagataaacatcactttaaacacattttattacattattggttaaattaacattgtgtttttataaagtcaggataaaatgttcttatttagaaattaggattgttttctaccattgattttccacaaattttcaatacaaattctagatgtttatttgccaacacgcctggatgctagagaacatccagcaatatggacctgaaatcagcccaggatccccagaatgcactcacaatggcagcttgctagagggttgtctgagaattgcaaacacattagggatttgaacttcatcatcaaagcactggtgagcctcagcgctgagcacacagagagcagcaggagctgcagagcccactctgtggtacttaggaaaaggactggatgttgtggggtgatgtctgcaggaccctagaaaagggtgacgatgtcagagagtctgcggatagatgaacatatgcttttttttttgagatggagtttctctctgtcgcccaggctggagttaagtggcattatctcagctcactgcagcctctcaccctgggttcaagtgattctcctgcctcagcctcccgagtagctgggattacaggtgcccgacaccatgcctggctaatttttctatttttagtagagacagggttttgccatgttggccacgctgatctcaaactcgacctcagatgatccacccgtcttggcctcccaaagtgctgggattacaggagtgagccactgcacctgacctacatgagcatattgtaaggtgaactgttatccttctaaacatggttgggttcaatgatcatgaagagaagtgaacagattcaccagacgtggaggagacaaaataaatagatttgttgcttctttgccaggagactgaggaagacaaaaggatttgacagaagggaaggtggagaaacagtgtgaagagcagaagaccagaacccaaccaaagtggaggaactgacccgtgaaagtggtgtttcatctccacaaatggcagacaaaatgaaaggaaacttaacaccgtgacattgttgagttattattagaaaagcattgactgtagtgtgactggcacagcacaagaaacaaaaacccatgcgtggaaccagagtttgaattaggcatacacaatttcttattatcaaaacacattgaattactattgctattattattctaaaaatatgcaaggttaaaagttgaattgaattcctatcctaagttaatgatttgtatgtgaaagaaaccatgggttacaaggaagaaatagtgagagatcgtgggaagacttttgcttgaccagctcaggaatcagctaggtctaaaagcaaacgtcaccttccccaggcacctgatgtggagctgcctcctaagaaaaccgtggtgtcctgagtgattgattccctcgtggttactgaaagccccatggtggccccgagcactccctgttggccctgaacccctggtgtcctcaatgttcttcagtggccatgagtgtctcctggttgtcttgtgggcctttaggtggtcctgttacacctggtggtttctgagaatctcttgttggtcctgagtgtttcctggtggtctggaatgcacccttgtcattctgtggcccctgcttgtgctgagcgccccctggtgtcctgagcgccccctgatgtcctaagtgtctcctggtgtcctgagtgccccctgctggtcttgagcacccctagtgttttgagcaccctgcggcatcctgagcaccttctgctatcctgagtgtctcctagtggttctgagtgtcccctagtggttctgagcaccatttaccacaaagtcccctcttgtcttcctgcagggaagtttgcgtctagactcacccatatgtccctcactgtgtctctcacagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttccaggaatctggggaaaaggtgtgtggattaggtgaaacacacactttttaatcacaatgaaactattttcatggtgttcaatgataaacacatggcataaataatttgtgaaaactcataattttttgagacaaagtgttaacctaaatgcatacaacttcaaaagtatttagctggtcatgaaacacagaataaaatgaaagctgtataaaaatatctaacaatgataaacaggtttgtactaatttcactgcagaaaggggggcatgaatatcagaaacaagtatctttggaaataatttgatgttgtgattgtaaaatataaataagctgcatataagcacggtattctagtcgataaacatattttcaacaagggtcagtttaataattctaacacaatttgtgtattttgaaattgtgcactaagtaaattaatgtcatatgataggaaaggtttcctcatttttcaatgtcagattatggacaggcaaagaaagaagctacggatgtctatgtggatcttggtagtgtgaagaaaccagtatcttcttaggtttaatgtaatatagatacagaagatgagatacataaatactttaattttgaatttttgtgggtaaatggtatatgtgtatatttatggggtacctgactttgatatagcatgaactgcataatactcacattatgatgaatggttcctacatcctttcaagtattaattctttgagttaccaacattccatttatacacttttagttattttacaatctataattatgttattaaggattatacttagtctgttgtgttatcaaatactatgtattatttgttatttctaaccacttttttcatccattgagcatccccaataatccccatctaccatagaccttcccagcctctggtgaccatcctttcactctctatctccacgagttcagttgtcttaatttttaacttccacaaatatatgagaatatgtgaagtttgtctttcggttctgggattatttcaattaatataatgaactccagtttcatccacgttgttgcaaatgaaaaaatctcattctctttatggcataatattaatccatatgctatatgtaccacattttatttatccatcatctgttaatgggcagttaggatgctttcaaattttggctattacgaacagtgctataacaaacatggtagtgcaaacaacattttttttttgtgggagggagtacatgccagcagcaggattgctggattatatgacaacactactattaggtttggaggaaactctaaactgttctccatagtggttttataaacttaagtgcccaccaacaggttatgagtgttctcatttctccatatccttcccagcatttgtttctgtctggctttcggatgaaatcattttaaaatcagatgagatgatatttcactgtagttttgttttgcattgttctgatgatcagtgttacacagcacattttatatgcctgtttgcaatttgaaagtcttattttaagaaataaatatcgcctgctttttattcggattactagatatttttcctatagagttgtctgagatcctggtatattctgatcaatcctttgtcagatgggtagtaatgtctctttctctcacactatgaaagacatgatgtcctcattcacaggtgcattccgggatatacacacagtatcaatggaaaagcagtcattaggcagtgaggcctttgacagcctctacctgatgtctctttttcggagtctgtatctcttaacataacaactggatgttattctgtactcattgctggcatgctgtcactgttttgtgtcaaaaattcatccacattttaatgcaattaaatttgttcctatttagagggtcagtttttgaggtttgtcatgacccagaatgttatttttttttttttaagaaaatgggtctagcaatatcttgcaggctggccttgaaatcctgggcttgggtgatcttcccacattagcatcctcactagttgaaaatacaggcacatggcacagtgtctaactgattattcttaaattatgctatttctcattctctctgctaaaccaagtggatattgctcttgtggagctgtcagcttttcattaattacttacagtaaaaatatattatgtgttttaggataacttcatggtaaaaattattcacagtcaactgcaaacatagtcacacaatttccagagtgctgtatctctgtctttatgccatgcatctttacctataaaaatataacagcctccaccttagtgcacatgaaattattcatatatctcaaagtgatactcctgctttaagagcataaaactgtttgggaatcgtggacttaaatagtctcattatgcctctcccaggaatatccccagaacctctgccatacaagtgagcaggggtgagaataattggagtccttcttggttcttggtcaataacgcatggcatggaaactctgtctcgtaagtgagggtgggaggaggcaggcatccattacatcacagactggaatttagtctccaccatagagatgtgacaccatggcttcaactgagatccgagggagagaaagccacatcttcttttcagatcagctcatgatcatgcttctgtcatcctgagctgcaaatgagagagtaatgcttgtctctcaagcatggtggatcctcactgcccttactgagacttggtaaatggtttagtctgtttcagctgctataacagaactccattaaatgggtggctcagaaatatcataaacattgttttctgaattctcaaggctaggaagttgaagatctagatgcttttgagatcggtgaggaccagcaatttctggtgaggaccggctattatgttcataggggtgtaactgacggacatatccaaacaaaaaattttgcatggatgttcatttatatttccccaaaactgcatacatgttgtattattcctgatcagttgagcaattataaggcttgaataagaaactaaaacctgcgcattcagcacacatatccctgaaattaaagtaaaaaaaaatctgtaaccaaacttacaaataaaggaggtaagaaaatgaggtcagaacagttaacattgagtcctcacgtgaaggccattggtggtaagttacacaatggggctgcagtgagataggctaccaggtgatctaattctgaacccctcaataacagccaaccagcaatctctggcagtgggtatgctagaagttcccagacatgggaaaactctcttactccataaaactgcactggggtcgtctgcagcctctaagttccacaggagcagctcctaccccagacaaatctctgctctttctctggggtcatgagagatgatgcggagaaggtcagtgatatggtttgtttgtgtccccacccaaatttcatcttgaattgtaacttccacaattcccacatgtcatggaaggaacctgatgggaggtgactgaattatgggcatgggtctctcctgagctattcgtgtgatagtgaatgagtttcatgagatctgatggattaaaaaggggagttttccttcatgtgcactcttctctagtctgccaccatgtgagacctgatttccaccttccaccataattgtgaggcctcccaagccatgtggaactgtaagtccaataaacctttcttttatgaattgtccagtcttgggaccagcgtgataacagactaatacagtaaattggtaccagtagagtgagacattgctgaaaagataaccaaaaatatggaagtgactttttaactgggtaacgggcagagattggaagagtttgcagggctcagaaaaagaccagaaaatatgggatagtttgtaacttcctagagacttgttgaattgctttgccaaaaatgctgatagttatatgaacaataaggtctagcttgaggtggtctcagatggagatgaggaactcattgggaactggagcaaattgtggaattttgaacttgagagagatgatttagggtgtctggcagaagaaatttctaagcagcaaagaattcaaaaagcccacttgagtgctattaaaggcattcagttttaaaggggaaacagcataaaagttcagaaaatttacaacctggcaaggcagtagaaaagaaatcttattttctgaggtgaaattcaagccagctgcagaaatttgcataagtaatgaggagccaaatgttaatcctcaagacaatggggaaaatgtctcctgtgaatgtcagaagtcttcacggcagcccctcccatcacaggcctggaggcctaagaggcaaaagtggttttgtggtccaggcccagggtgcccgtgctgtgtgcagcctaaggagttggtgccctgtgtccagccactccagctatggctgaaagacgccaatgtagggctcaggccatggcttcagatggtgcaaaccccaagccttggcagcttccacatggtgtagagccagtgagtacacagaagtcaagaactggtccttgagaacctctgcctgggtatcagaagatgtatgaaaacacctgggtgtccaggcagaagtttgctgcagcagtgggaccctcatggagaaccgctgctaggccagtgagaaaggtaaatatggggtcagagctccaacacagagtccctattggggtattgcatagtgcagctgtgagaagagggccgccatcctccagatcccagtgtggtagatccactgacagcttgcaccatgtgcctggaaaaggcacattcactcaacaccagcctgtgaaagcagccaggagggaggctgtaccctgcaaagccacaggggtggagctgcccaagaccaagggaaaccatctgttgcatcagcatgacctggatttgggaaatggagtcataggggatcattttggagctttaatatttgactgctctgctggattttggacttgcagagggcccctttgttttgggcaatttctgtcatttggatgggtgtgtttatccaatgccagtacccccattgtttctaggaagtaacttgcttttgactttacaggtttataggtggaagggacttgccttgtctcagatgagatgttagactgtggatttttgagttaacgctgaaacaagttgactctgggggactgtaggaaaggcatgattggttttgcaatgtgaggacatgagatttgggaggggccatggggcaaaataatatggtttggctgtgtccccactcaaatcacatcttgaatttaactcccataattcccagtgtcatggtagggacccagtggtaggtcattgaattatggctgcgggtttctccagcactgttcatgtaatactgcatgagtttcacgagatctgatgattgtaaaaagggagatccctgcacaagctctcttctcttgtctgccaccatgtcagatgtgcctttcaccttccaccatgattgtgaggcctttccagtcatgtggaagtgtaagtccaataaaactctttctattgtaaacttccaagtctctggtatgtctttatcagcagcatgaaaacagactaatagtcagacatgatctactcaaggcctctgcacatggagaaaagccagtgaaagtggaaaatgtattttcttgatttattgaaaaatacctatagaaaacacaactgtgtgccaggacatcaagcagaatttaaaaattatgcaattggaataaatgtgaaaattacaatcatttgcagacacacatctgttcatatatctttcaatgaaataaagtaaatgccagtgttctgtgtaaaaatcaacaaagagtgtgttgaccctgagaatacacctctctccctccctttaaaggcaggaaaatgcacatggatcaggtgtcaagctgctgctttctgacgtctatgctatggcccagatcctgtggtccactctaatgaaaggaaggactctttagtgattctgaggcagagtcattgctggagtcacaggggttcccccttgggtaatgttgacttgtagtagactcaaatatgttttacaccttccttgcacagcacagaaacctaagaatgtttcacccaatcctccgtccatctctcctttactcagggacagatttctaccatatgccatcagcttctgcagccacatgtcaccccctgtgcgtttcctgtcaaaagagtggaagtacttcttatgaaaaatgcatgaaagcataatccagtcttggactttccatctcaaaagaccaataataacacatatatttcagcaaaattatttatcctatgattatgactatatttggcaattgttttggcaaaaaacaaaaatcatggtgttggataatgaagatgtaagaagggccaagactgttacaactttttattgatgacctggggcgtagtaggggtaggtgctgacctcaagataagaggactggaacctcattgcaactgtctgagtgtactcacgcaggcctgcgtggggttccaaggcttgcatggcaaagctgtcagtgctgtcatctataattccagcaccacattggagggaacaacatactataaagtacataatgagaactggggtaaggagtgcaattcgcagttttaaaagtaaagatttgaacgcattagtttatggctttgtagcctacaaataatttagaatttcgtccaaactgctgaagaaaaaaaaacaagaacagcaaacaacaggtgtactatatttttaaagcataatttttttctctcttgtccccatttttatttaaaacaaatcaagataggactgatttatttgcaaaataaactttagtcttattattcatggccttattatttgcataaagcacaatacaaataattattgtttacacaggcttttaaaattggctttggtggaactctgttccataaggaatctcagataagacttttttaaagccaagcccagccatgagtttttaccatcaaatacctgtaagtctggtaaattatttttcctctggggtcccaggaaaacatggggttcttgggcctgttagaaagtgacattctttacttaccactggtcaggaaccttgtacaaagactgtgtggacaaggtacaggccagttttcccaaggggctcttattggctgtataagtcaagttcgattgcttaaggtgaagcacgccattacagtcaaagccttggtaaaataaccagtttctccaattgtgtcctgttgcaaaaaaaaaaaaaatcttactgcacttatgaaaaatcatattgccataagttaaggatattcacaaagagtttccaaattctggagaaagtggacagagagaaacaaatattctccaaattttatgtacaggactatactcaattgttgaaagctataaatagctcaaaagaaaagttttcttgggcaacattttaagtgaaaagtcaaaaaagatagtcttctatttgatagttttatctctatactattgtaaccatcttcagagtttttaatcagaaatctgcatgtgagagcacctgttagagtttcatagatggttataaaaccatcacttaaagagaaacaaaacaagtcgataaggtcaaaactcaaagggaggaattgaagccaccactgcaaagctgcaactgaaacagtgaaagagctgtgacctaacctgctccatcttgcctcaaacctccaggttgtccttgtgcattcctgggtgtaggcttacctaacattgggaggaacttagtttagtttatagtttaaaacagagacaataactgccctttcccaaaacaaatctccttcgtcctggggactagactgcctttgggggactaacgaattagccaaaatattagaaattatgttttaagagtcatgcagctggtggctacaaattctaacccttcctagtttgctcctggggataaaatgactattataaagcctaagatcaatgctttagatattttacagactctgcacttgatggatcagctggcatcacccagatcaataaactggctcatccgatcttgtggccccctcctaggaactgactcagcacaagacaccttcagctccctatgattttatctctgacctgatcaatcagtactcatgactcactggctgcccccaacccaccaagctatccttaaaaaatcccattcttgaatgcttggcgagactcatttcagtaacaataaaactctggtttccaataaataaataaataaataaataaataaatgtcatggcaacaatcaattttatgtgtccccttgactcatagagtcatttattcagttacacactaacctaggtgttgtactgatcctataatataagtgttagtaaagcctgccatcatttttttcctaagtcaggaagattgtcctagataacctaggtggggctgattccatcagagcataagagatgatgatgggactccatggaggatgacagtgtaggtcttcccagaaattccaactccattgacctgaaaccctgtaggatttgcctagccagaccctccaattgctgtcacccagagctcacagcacaatagagtgtccatccttagctttccccaaagtcacagatgaaggaggaaattctgtgacagtgtgagaaacagaagatcagctctacatcagtatctcatttgagaaagctaccattatcccctcagtgactaatgtccacttcatttcccaaatgcctccatgcacagaagacagcaggcgggtccaggcaatggtgagtgggaaagtcccctcagcctccccaggtctcacaggagccacagcctgggccacacctgagttccaggtaacaggcctgagccctgagatttagaccacagaaaacacactctctgttttctgggaagggaagaaaagggaactatgagaatgaagtgtagagagaagaaaaattgattagcaagtaagggccagctggatcagttctgagtcagatgtgcacagttttgccagaggagggagaacagctgtaaaaactgtcaggatttaaggaccctcccatgggtgagactccctcttggcccaagtctgaatcccaaacctattctaatcagagatttccacggaggtctctgccctgagcctgactggaaaacactccccaggttccactgggcttcctcaggacactgatcaatgtgaccaaggcagggtcatttctgcccccaaggtgacactcgggcttctgtaggggtgaggatgggtcttcctgttacaaaaaacaaaacaaaacaaacaaacaaaaaacaaatatgtgagggaagtttagcagtcacagacatcaaatgttagtacagaattgcaaatctagagaagttccctcgggtaatttggtaacaaggcagccccagatcaagacaggaaacccagcccttgtagcacctgcacttgcccctggggtcagcacagtgcacagtgtcccaggctttccctggttgtcccaggtaccctgaagggaggtttgtgtctgggctcacactgacttctccttaccgtatctctcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacctgcaaacacagagacatcctggtaagaaactgccacacatatccactgtttcgctcacttatgtccattcacactcaatagctctagttctccataaatcaccttttaaaatagcagcaaggaaaacccacctcagccccaactccatggtgaatcctgtatgttcagtgttgaccaagcagaaacacctgggaatcccggggctgaggctcctctgccagagctgcagggtcagggtttagctggttttcatcagcatggggagggccctatttgcgtgtctcctgctacacagagagctctggggtgggaaccctgaggagatggcagaccccagataaaatgacagggccccgcaggaattgggtgacaattatggtatttggaaaatacactgtcttattatgaaaatgtgttgtgataaacattttgcactattatatttttacatatttgtgtaaattatgttctgtagaagtcaatggtttctccatttacagatgtgaaataaacccacacacggaggaggggctgtgtgtgtctcatgtctgagatgaatgagccctggtagcttggcctgtgctccacatcagtggccccagttactccctgaaccaactccaggtaagaattggacatgcctagtgtgctttgtggaacccacttcctgtattgagaacttgagtgatttttgtggcactctagcattcacctaaaaataaggagagaactagggttcaggaggcaaattctcatatatttctgacttttaatggatattttgtatctttataccaccgcttttggtctaatttttcatttgtttgcttgcaataaattttgtgagtgttaattggcagataatacacttcacgtatttaaagtgtagaattgaaaacatgatgtaagcgtcatcattactgaggtggacaagtgagttcccctcaacattttctcttgttcttctgtatgtttccacatttccccttcctttattctacccttttcccaggtaactactcatcttttgtatattactttagatttttttcatttgaaataaattacataaatggagtaatatagtacatattcttatttgtctggcttattttactcagcataaatacttagatacttttccttgctgttctgtgtaccagaaatatatttattataaatgttgagtagtattccagtgaaaaaatttaccagaatttgtttctctattaggcagctgaaaaatgtttggattcttttattattctggatctcactaaaaaatatgctgctaagcttaaaaatgtacatagatgagaaatatatatatatatacacacatatttatttatttatttatttatttatttatttatttttagagacagagtctcactctgtcacccaggctggagtgcagtggcgcgatctcagctcactacaagctccacctcccgggttcacgccattctcctgcctcagcctcccaagtagctgggactactggtgcgcaccaccacacctggctaattttttgtatttttagtagagacggggtttcaccgtgttagccaagatggtcttgatctcctgacctcgtgatccacccacctcggcctcacaaagtgctgggattacaggcatgagccaccgcgccgggcccatatattcattcttacaacaatagtatcaacaataacagataaacagaaaagatggaagtttgcaaattttacttaatgcttcagataattgagggttgaaaacaaacaaaatatttgaaatctagggagaggcaagttcctgtagagagtaatgaagccagagtatgaaattccctgaggcagaggctgtcatataaaatgtaggctattacaagatgaagaacaaatatacactggattgcttgaagtcgagtgtgttaggcatgttatagtgagaaattctaagggacctcatactggagagttgccctaatctcttgaatcatttacccctgcaaaacatcttcctttcccatagtatctgtctgggagagaatgagctcacacttctgaaatgcatccagacccagttctctgatccccactacaaaactaagatattaccctgcaggagcaagccatgaaaatcagcatcctagggcactggtgcagccccttaagaattgaggtatgaacagaggttcccatcaaagctctattgagaagcagctcccctcactttcttacggaatcagagctttaatctgcaggtcatggcagcagatctggaagttggggacaccaacagagattatgagagctgtgggagggaacaactggggaaaacaagaggaatctgccccaggggaagcagcaagaacacacagaccagcatctcatctggaggagggttgggaacacttggaaagtcagctcacactcaggatcacaatgattttctggaaatatgaccccatgagaggtcagagacaattcctttagtataatgtcttccaccaatttcacaattggcaattaaatataacactttaatccaccttaagaatctgaaagagattctctgtggaatggaatgattgtgtatgaatcatgccatgaaactgtcttcacggtgactggatttgcctgttgattttgacatgatgaccatgatgttgatgacgaagatgacattctcagaaaaataacccaggttcaaagagctaactgcagagtcatatttatgtttgttttacttcgggacagaaagggcatggaagtctaaataacgtaataaatggtctcctgaggtttggatgctgttaagcaaaataagacaacccgaggtggcggtcacagggctccctggactggttcctcgctgcctctgctcctcactgaggctctgtcttgtgtgagttctgagcatctcctgcgggtcctctggtgcccatccagcccagataaaggagggctgggggttctgtttctcaggtgctcagtcctgtgcctggctccagttcaggagctcagcctgtcctgtgtgcagaagcttttagctctcccgtgcaacctcgcctgtacactgagtttcttcacagcaaagtgacagggtcagcttcacagacatcgctgcaggcaattttcagcaaatctaattttagtttgactatgtaattcagcaatcatgttcattgtggtgtaagtgactgacatatccacacacacacaaacaaacacacatgcacacacacacgcacacacacacacccaaactgcatggacattcatttacatttcccccaaactggacacatttgtattattcctgataagttcagaaagttctgaggttttaatcataaactaaacataacattttccataaacaaaattagtaatgaataagatgaaaaaatcgggtcagaaaaatcaagattgagttattacccgcagtctaatggtggtaagttacataatggaactgtgatgagacaggctcccaaggtgctctaattcttaacccctcaagtacagctgaccattaatctccgagagtgaggaagctagaggttccccacacggaaagctctctgactccacaaaacttcgctgagcttctctgcaggctcagaggtgtgcagactcctaccccagattctgcagtcaggcaaatctctgctctttcccaggggacacaagagatagtgtggataagggccagatgtgctctactcaaggtctctgccacatggagaaaaaccagtgaatgtggaaaatgccatcatctcgatccttcgaacaatgcctgtgaaaaactcaactctgtgtcaggacgtcattcaggattaagaaataatgcaactgaaggaaatgtgaaaattacagttgtttgcaggtgcacacttgttcatatattttccaataaaaatacagcaaaagcaggggttctctataaaaattcacaaacagtgtgctgaccctgagaatgcacctccctccctcctcctacaggcagcaaaatgcaggtggatcaggttcccagcagctgctttctgacatctgtggcatggcgtgtgctgaggcccatgtcctgtggtctactctaatgaaaggactgactccacagtgattcctaagaagagccctttcttggagtcacagggatcccctgagaggtagcactgacttacacgagactcagttatcttttgcagcttccttgcatagcacaaaaatataggaaccttcctcccaatcctccctccctctctcctccagtcagggacaagcttccatcatacgccattagcttcccagcctcattccactccctgtgcattttcgctcaaaggggtgaatgtacttcttataaaaatgtagggaaacttcattccatcttggggttttctgctcagaacacgaataatagcacaaatattaggagaaaggggtcccaatttggggaaaatccacagattaaaatgaaaacaagtttcttatgcaagtaaaataatgagactggctacaccagaggtggagcagcagtatgggctgctggttgtccattttatggttatttcttgattatatgttaaacaatggatggattattcatgagtcctccaggcaattcctgaagttgagtgttcctcccctcctttttaaaccacacaaggaaacttcatgatgttgccttgacaactgtaaactgtcttgggggctggaagggagtgttttttagcatgttaatgcattataattagagtataatgaacagtgaggacaaactgaggtcattttagccactgtctcggttttggagggctttgcccagcttctttactgtaagatttatctgcaaggcctttatgacctggatcttgtgcagacctcctatctcatcctgtgactaacttactgcatcaacttactaggaatccagcccagcaggtctcggtcttatttttcctagcccctattcaagatgaagttgttccagttccaaagcctctgacacactcaaaaaatgtagcaaaagtatttataatatgagcatgattatattgccaaatataaaatatcataatgacaacaatcaattttacctgtcgtcttgactagatcacagtctcatctactcaatcacacactagcttaggtgttgctcccatggcatgatacaggtgttaggagagcttgccattatgttttcctaagtcatgaagagtgttctagataaactaggtggggctgattcaatcacagcataacagaagatgatgggactccacggtggatggcagatgcaggtcttcccaggaattccagcctgtctttcctgaggtccagaagtattgaccttaggctgcctagccagaccctacaattactgttacccagagctcacccacaatggactatccatcatcaactctcctcaaagttataggtgagggtccaaactctgtgacagtgtgagaagcacaagttcagctctacatcaatatccaattggagaaaactagtattattcccttaatgactaatgtccacttcatttcccaaatgcctccatgcacagaagacaacaggagtgtccagacaatggtgagtgagaaagtctcctcagcctacccaggtcctgcagacctgagccctgggattttccctgaaaacagaaaacacatcgtttgttctcagggaagagaagaagaaagcgaactgtgagaatcaaacctacagagaagcaaaatggattagcagaaaaagggtcaactgaatcagtctgagtttacaagacgaggggggatagctgtgaaaaccatcaggctttaaggaccccgaccctgggtgagcctgtctcttggctcccatcagagctcaaagcccgttctaatcagaaattcccatggaggtctctgccctgagtctaattggaaaacactctccaggtttccctgggattcctcaggactctcatcctgttgaccacgaaacgattatttctgcccccaaagtgacaccctggcttctgtggagctgaggatatgtactcctgttgcaaaaaaacaaagaaacaaaaaggacaaaaaaagtattgcatttagagacatgaaatgtcagtacagaattgtaaatctggagaagttcctggggaaatttgacgacgaggcagccccagaccgcgacaggaagccagccctcagcagcacctgcacctgccctggagacagcccagtgctcaatgccctgtcgccccctggtggtcccaagggacccctgcagggaggtttgtgtctgggctcacactgacttcccctcactgtgtctctcgcacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacctgcaaacaaagagacaccaaggtcagaaactgccacacaaatccactgtttctcacactcatatccacacacactcaatcttcctagttttccatgaatcaccttctaaaatagcaacaaggaaaacccagctcagccccaattccatggtgagtcctctgtgctcagtgctgatcaccaagtggaaaggccttggagtccagggctaaggctcctctctgagacctgcagggtcagggttgggttggttttcatcagtagagggagggccctatttgcatgtctcctactatataagaagctctagtgggatgctggaggaataggctgtacccatataagaagacggtgctctgcagaagtttgctgacaatgatggtatttggaaaatatgctgtcttatgaaattgtgctgtgataaacactttgccctgatcaccctattacattttttaaaaaatgtgtaaattatgctctgtaggagtcagtattttctccttttacagaagtggaagtaaacccacacatgggggggctctgtatgcatccaggagctcatgtctgggatgagtgaacgctgccatctggccctgtgcttctcgtcactggctctgacatccccctaaaccaactccaggacaaagctgtacgtgcccggtgtggttttcagaagccactttctgtaataagagcatgtgtggttttgctgctgttctgtgtgtcaggcatttatttattataaatcatgggtagtattccagtgaacacatttaccataatttgtttttctattaagcagcttaacaatatttgaattctctgtgactctgggtcttaccaaaaaacctgcaactcagcttcaaaatgtacatagatgaggagtatattttacttactgttttacagcatcaacataacagataaacacaggagatggaattttgccaattttaaaatatactttaaatactggaggttttaagataatcatcaaatccgaaatttagggagagacaagttcttgcagagagtaaaaaggcatgggtatgagttgaactgaggcagagtctggcatataaaaatgtaggctattataagagaaaaaaatacatacatactgaattggtgaagtcaagtgtggtaaatgtgttgtagcgtgaatttctcagggaccacatactgaagagctttcctataccttgaaacctttttcccaaaaatggggacagtcacaaaaatcttttgtcccaatgtgtctgtctgggagagaaaaagagcccacactctgaaatgcattcagacccacctccttaatccccattgcagaactaagaaattactctgcaggagcaagccaccaaagccaggatcttaggggcactggggccatcccttaggaactgagatggaaaaagaggtcttcacctaagttccattgagaagtatctcccctccttcttatttaatcagagccttaatctctaggtcaggtcatcaactctggaagctgataacaccaaaagagaacattggagctgtgggagggaacaactggggaaaacaagaggactccacagcagggaaaacagcaagaacacacagaccaacatctcatctggcagaagttcagaaacaccggcaatgtcacacccagactcagggtcacaatgccttcgtagaaatatagacccatgaaaggtcagaaaatctccctttattctattgccttccaccaatttcacaattgtcagttcaatataatatcttaatccacctgaaggagctgaaagagattctctggaggaaggaacagggtgaagagacaaagccaagcaggaaagaaaaacaaggtatcactggaggatctgaagtctctggtggacacagaagaacagacttcaactatgacgtctactgcaaaagtaaacgtcaaatgtagctctgagaagattcaaacatttccacattaaaggcctggcaaaaataaagtatggtcaaatacaggcagaaaatgcataaaatgaagtaataagccaatatcaactgtccaacctaaaatatctggctatcaacaaagattacatatattaatgagaaataccaaagtcataataaacaaatgatcagaatgagacttctatatgatatggatcttagaactatctaattaaacaagatatataaagtaactataattcatatgtaaaaatctattaaggaaactgtatacataatgaaggactagatagggaactgagagttgaaaatactaagaaaaaatcaaatggaaatgcataagaaatcaaaagcaatgcagtataaacattgagtaagctttgggcacacccttcagtagagctggctcaccttttaaatgaaaccactcacttaaaataccactagaaattttacagagtaaagtgcaaggaaaagagagtgaagaaagtaaacattaatattaaaaagtattgtatatgtacattttaaatctgaaaggagaaattgtagatacagagacagtatttgaaagaaataatggctaagaacgttcccagttttgtgaaagacactgaactacagatcctagaatcacagagaacctcaagcagagtaaacagaaatagacacagacacccacaccacacatccaccatggacagagtggtgcgcaaggaaaaagtcacacatcacacaccacgtacacatttcctcaactttatagtttttacttagttgttttaaaattatttgaatttatggtattaagtagaagtctaaaattaaaatatatcattctatgcataagcctgtctattcttaccatgatcaaatacacggtttggttcaaatgaatgtaactacgttgttaggaaattcacatttcaaagaaaaatggtatttattcctggctctgtgttgaagcatttgtaatgtatgcaaataaaatctgttttaattaaaggattttttaaagttagcacataataactgtatggggtacagtgtgatatttctatgcatgtgtgccatgtggtatgattaaatcagaacaatgaacaaattcatcagcttagacactaacatttctttttgttggtaacatacaaatttctgtcttctggctacttgtaaacataaaatgtgcactatattgttaacagcagtcaccctactgcactgtagatcactggagcacatccctcctatctgcctgtaaattatacgtttgttaacaaacctcttattgtctctcagtctcctcccattcccggcatctcataaccactactctattatttacttctagaagatcaactttttaaaatttccacataacactgagaaaatgctgtatttatttttctgtgtctgtcttgtttcactcaacatgatggtgtccagttccatccatgttgcttctaacagcagaatttcatttttaagactgaacaatattccattgtgtaaatataacacattttatttatccattcatctgttgatggacacatatgttgatttcatatgttagctatggtggatagtgctgcaataaacatgggtgtacatgtatctcttcaatattagttttttactttaatgatttaaatagatacatactcagcagttggattgtgaattatatggtagttctattttttcccatgatggcttcactaatttccatttccaccaatggtctataagagtttccctttctatgaatcctggccagctcctgttttatttatttatttatttagattttctgactctcaagcaaagataaaggatgaaaagacatctcattgtgaatgtgcattttcctgaatattagtgttttctagcgatatatgtatgtatacatactaatatatctatttatctatctatcatctatctgccctttttcttttcttcttttgagaaatatgtattaatgttattcctccattattagccacattattatttgcagttgggttgagtttattttatatgcttgatagtaatcccttgtcatatgaatggttttcaatattgtctatcttctgcaggttccctcttaactcaattgtttccttcactgtgaaggagctaaactctcttgatagaacctggacaggtgggctgaggtcccaatgctgtgggacattggaggggaagagcttgacccaatatcccgaatcaagtgagcttttactcaccatgtggtttctgagtttatggtttgaacagatgcagaagagtttgtcatggcattctgggggataaagaatttgaagagagaatgacataatttattagtcaagtaaataaaaatgtcatgattttccatatgttcttgtgagtgggggtagctcagccagtgtgtgttcatctccagaaaagagaaaattatgtctgctgtgaaaagaatgcatagcttttgacatatgtggttgttatataacaactgagccctggatattaggtcatgttataatgctagtgggaagactcagtagaagaaaaagtgtcatagcaacaaaaatgaagcatcaaagatttaaataaaaagggtttttgaatatcactagtaatgaatatgctgagaaaaatcaattaccataatcagaataataattcgtgaccgcccataggattcatgctgagatgatataaaatttccattaaatggctcatcaccaccctcataaaacggttcagacaagaaattcagaacagtgtgaccttacagccagtggaggccaaacctttgaggagagggagagtctgtgttagaattgtgagaaatacaaacctgaactctgcagagaagcaacagtgatcaaaggcagtgccgagtccacttgagtttagtggtgaacacagtaaagatgggtttctctgccctcattcagtttttgttctcaacactctcttggaagctcagttgtgaacactgggaatcttcctaaaactcaattacagcaaaagcaatttttcactgaagaaagaggtaacaacatgggggtaagtaaatttgggttataaaaattagttattgaaacctcaatgtaagtctctagtaatttaaatcataaaatgttcagcctcatcaatggagtcttcttatcttgtcagagatgagtgtccatgtgggcacgtcgcgcagtcatggaggctggggagatggtctgtccaggctttcctggtccttcagaggagaagtgcagagtcgtctcctctcctgctcccaccagttttcatatctgtgtgtgacccttgagcatgtcatttccatgcgcttgcataataggagtcaaatggggcatgaagctgacatgctggttgtatcagtataattgggcaaagaaactgcctgcatacatgaactcttgcattatccaggcctggagcctctcacatctacactttgcattttattaatgatttcctgtgttgtttagtcagttaaaatgttctttttaactttcttctgaaatagctttacacaataatctagaggcataaagattatgtctcacataataatctagaggcataaagattaaagacaaacttaaaacttattaaagaataactcaccaagttccagttgtggtcatagttagtttgtggtgattgtgagacagggagaagcatggctggaaactatgactgtgctcgtaaatgcttcatgttaacggggaagacactgtacacccaagagatttagacactgccactgagaacctctacctaatattatatgttatgaatcacacctcaataataaaactctaggttaatgacaaaattgctcttactaatataagatttcctttagaacacagtcctctatctgatgtaaaatcagcacagatggcagaagagattgcatttattagaagtgccaatttgttaaactaggaaataaacatgtttcagggcagtgcatgggttcaggatgctttgaaaaaaaaaaaaaaagcatctcacacattctggaaaacccaccaaaatgggcaagttagggaacgtttacaggcactccttttccccagattcctggcagatataaaggtggaagtcaatgcaaaaagaggtaacattgaagctaagaaaactgccataccagatcatatcctcaaaaggtaaagctgctgagtcacagatattatcaaaaatatcaatgctgagccgctgatcttaaataaaaatgagtgaaaatacatagttaccatatttgcttaatttgtgccagatcatttcaaatatgtatttgttgcatttcaactctacaatttatagaaaaattggttaccagattaaataaacagtttgccacttggacacatttatgtaaactttcctcaatttccacacttaacgggatatgaatgtattttatttatcatctatctgtgttctctgtgtcttccaataattccttgacaaaggctacagctctttcagttgattaaaagcttctatattttctgtttttagcctgtgatctgccaggtttttgcatgaaccgagtgaagcacactcatgaaaggaactgttataaaatgattctgtgaggcagggctgatactaaaatatggcattgttataacctcccacagtcttccacataagtttaaaagaatggtattcttacattaaaattatcagttttaagaaacccttgaactcccttgtctacatgtactcctaccagcattgtggcattatggtcctctgtctcaaggatgtatctgttattttcctatgacttggtagctggaaaaaaacacatttggaaatcttacctccagtactagcctttgacctattgtatttggatgaggcagaacactcaaagagattcatgtattatgctcactcctatcaatcagcaaaagattaaagctgccattccagttgtgtttttaacagccttttactatctttagccaggaaaatttatacattggaaaaaatttagagaaaaacttcccttgaaacactggaaggaagcttgttagatatttttgtcaacacagcagtaaaactccacggagtcagtcctagggattatgttttacaactgaataaggaattaaaaattccacacaattggaacgctactccatagaggggattttgacctatttaatttatataccaaccttcacttaaaggcactcttctatggttttccaaacttaagcaaatctctgtaacctgctgaagtctcctcagtgcactttgtctctagatagccacacatgaaaaagcaaattttgtgtatttgtgcatgagtgatctggacacacccttggtattttaactgaatttcatggaaacatgattactgactgtgaactcatatttaatggcattcaaaaatgcatcacccttgtgatgtggtggaaattggtgcctgtgagaaatatgctgatgcttcacttgaacaagttctagacccctcccttgacttcatggttcctcactcggtacagatgtgtctatgagcaaaactcaacactgatacagatatccagcactttctcctgttgagaaaattattttttctctttctaggcctgactctctctctctccctctctctctgtcttgccttttcattatgatttttgccatatcattctgaaacctcccaacagtatgcatcatgaatcatgccaatttcaagcctcaaaaagaaaaaggtgcaaactcataatttcctgaacaaggttagaaaacttcctgcatttccaccagatccattagagactcctaatgagaatcatggtcaaacattattt

SEQ ID NO: 1218 - DNA, 9255 bp, Homo sapiens
aggttatttgcttctttctgatgaatcacacattgctctagatagaaatggtggtagcaaaaacttacagcaagaacaaagtaaggaaaactaatgccttacttgatatttacttcctattagtacacaaaaatatgatttcagtgttagcttttgtgaagactctccagttttggaagtagagatagcctcttcagctactttgagataagagattgagaagtgaaaatacttaacgtccaagttgtggagataatacagaattttaagggaagtgagaaaatgtaatcattttctcctcatccccacttaccaaaggttaattcctttaaccaaagaattaccaaaggtaattctcaatctttgactgcctcgacacgtatgttaagagtctctagactctctgcactgagaaacttgtctttctcagtttctcagttcaagaaagcatgcttaagacttactagtaaattacatgtaactgataagtatgtgtgtgtgtgtgtgcatacatatatatatgactgatcaaaattcacgggattgcaacatctcaactcagatctgggggctctaagcaaagaacagaatatttgcttgatagaattaaattatataatgttttatttcagtagttattttgcagcatagtcaatggtatgcatctttatgtcctctataggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatggtaagagcccatgtgtgcatacatgcatgaaggagtttgtgtgtgtgcacttacttaagatcttaggatttttttttttttttaaacggatccttgctctgttgcccatgctggagtgtagtggcacaatcttggctcactgcaacctccatctcccggattcaaggggttctcctgcctcagcctactgagtagctgggattataggcatgcagcatcacaaccggctcattttgtagttttagtagagacaaggttttgccacattggccagactggtgtcgaactcctgacctcagctgatccacctgtctcggcctcccaaagtgctgagattacagacgtgagacgctgcaccgggccagatcttaggattgtaaagtatgtgttgggaattctacatttgaagacactttaaacaaatcctttttattatgattgtattactttaaaatttaaatgataattttataaatcagattgtaagataatatctttgtccatgttagtatattagaactttattttggatatgtttgtttttaagatcaagataaattcaaggcctgcagagtgactcatgcctgtaatcccagcactttgggaggcccaggtgggaggaccgctggaggccaggaattcaaaaccagcctggtcaacatagtgatgatggcagcggcaggctctctggagcggctgcagcagggaggcacggctgaggctacacactctatggagcgggtgggagctgaagacaggtgggagtcctgccccttccgagttggcgctggagctccgttggtgccgctgcaatcgcccaagccatggctgtagtccctggcatccctgtgctctcccagtgggaacaggcgagagccccaactgcccaggcgcagctgcagcagctcaaacccgcggctgcagacctgggtctcccgctccacggagcaggcaggagccctgccttctccacacagctgcagctgcccaaaccgtggctgcggacccaggcattcctgcattcttgggggtctgggaaggcccccactgctcttacaggcttggaaatgcctgctcccactgcctggcttctccctgctgtcggcgcctgctccgatccaggagcaaagtcaggcagagcccggtcgctgtcgcagcccagccaggtgtgcacacgctcagggcactgctgacacaccagccccctgccgtcccggccccttctggatttggggcgctgacacgagcgtagaagggaagctgagcggcggctgagagcagctccccactggccttcaggcaccccttggcacctacagcctggattccgtgatcggcagcaggaggcagacaggttccggggcagaagggggcgggtttccggtgaggccccactttcgggccagggaaggcctgaaggctgggggcccagctgccaatcccacacaccagagtggaaacttgtggtgctttttccaggcccactgtgatcatcccactgcactccagcctgggtgacagagccagaccctgtcaggaaacaacagatgctggagaggttgtggaaaaataggaatgcttttacactgttggtgggagtgtaaattagttcaaccattgtggaagtcagtgtggtgattcctcaaggatctagaactggaaataccatttgacccggcaatcccattactgggcatatacccaaaggattataaatcattctgtgataaagatacacgcacacatatgtttattgcagcactattcacaatagcaaagacttggaaccaactcaaatgactggattaagaaaatgtggtacatatacaccatggaatactatgcagccataaaaaaggatgaatttatgtccttttcagggacatggatgaagctggaaaccatcattctcagcaaactatcacaagatcagaaaaccaaacaccccatgttctcactcataagtgggttgttgaacaatgggaacacatggacacagggaggggaacatcacacaccggggcctttcggggagtgggggactaggggagggatagcattaggagaaatacctaatgtaggtgacaggttgatgggtgcagcaaaccaccagggtacgtgtatacctatataacaaaactgcatgttctacacatgtaacccagaacttcaagtataattaaacaataataataaataagtaaaatatatttttaaaatttttaattcttagtaatattcagtatgtttacctatgtaattatcttttgttgtagcctgcagaattttcttcctgccccttgaactctgatgaagaagtgaataaatggttgcatttttatgaaatgaaagctcctttggtttgtctaccagtttttgtctccagagacccagtaagtctgtgtctgttttttatattatactacaatgataatgcttgatttttaggataatctttaagaactaggcacttttgtgtttgttgttgttgttgttttgagacagagtttcactcttgttgcccaggctagagtgcaatggcaggatctcagcttactgcaacctccgcctcctgggttcaagcgattctcctgcctcagcctcccgggtagctgggattataggcatctgccaccatgcctggctaatttttgtatatttagtagacggggtttcaccacgttggtcaggctggtctcaaaccactgacctcaggtgatccacccacctctgcctcccaaagtgttgggattacaagcatgagccaccatgcccggccatgtgttgttgttatttaagaatgagggtagcctctagaattattttggaagataagggagctcttcaccatcctatgagttaggcagagcagattttacctttgagaaaatgaaggcacaagcattttaaataacacccaaaattattttattaaatagcaggtgtagttgggcatggtcacatgccccagtattcttagctactgaggaggctgacttgaacccagaagtttgagaccagcctgggtaacagtataatccccatctcaaaaaaaacaattagtagagtcacaactaggattcaggtctcctgtcatcttgtttggtgttcattatattataatactatacgctagaaaaaatattacagaccaattcaaagcaaatacctactaaaatattggtcatatcttctcttttttttattttttgtgacagagtctcgctctgttgcccaggctggagtgcagtgatgcaatctcggctcactgcaacctccgcctcttgggttcatgtggttctcctgcctcaccctcctgagtagctgggattaccggtactcaccaccacacccggctaatttttgtattttcagtagagacagggtttcgccatgttgaccaggctggtctcgagctcctgacctcaagtgatccgcccgcctcagcctcccaaagtggtgggattacaggcatgagctactccgcctaccctggtcatatcttgatccagtgattacatgcctaggatattatacttaaatatatgcataattgtgtaaaattactagttaaaaggttattattacagtattgttgtagtagcaaaagaattagaaataatgcaagtgtcagttgagaagttacatacgcaatagaataccatgcaggtataaaagaatgaggaagctcttttatgatttcatatacaaagatctcaaaactatattgttacatgaaaaaaagttacatgcagaaaagtgtgtacaaaatactacatttgagtaaaaataaaagtaagtatttatggaaggatatacaagaaaatgcttacactggttacctgctaggaaggggagtgagtggtgagggcaagagagaagaagatacattttactgaatacatcgttttgccccctttgaatttagaacatgtgaatgtattacctatttaaaaaataaaaactattgcaacgtaaaaagttatccctcccccttaaactctaatcaataatttgagtactaacatattgtttgtctgttatcttaggggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacctccagacaaaataatattaatagtctatcatttaacaaatatgtattgaacacctacccttctctctggagtgtacacttcatgtgggcaagggccttgttcacgactgtagcactagtgcctttaactgctagcaaagtagccactcggatgattataccaaacactttactaaagctggggatctgtctagtggggaagacaaacaataaatatataatatgtcaggtggtattaaatgctatgaaaagaaaggagtagatggactgtaaaggaggatgctatttttttgtggccatcccgcactgagacaggatgcattccacactcaaaatttggttcacatgtccagactgatagccaagttcagtggctcacgcctgtaatcctagtacttagggagaccaaggcaggaggatcacttgaggccaggagttcaaggccagcctgggcaacagagagagacccccatctctgcaaaaaaagaaaaaaaattttttaattatctgggcatggttgtgcacacctgttgtcccagctgctcaggaggctgaggcacgagaatcacttgagcccagaagttggaggctacagtgagctatgattgtttcattgcactgtagcctgggcaacacagtgagaccctgtctcaaaaagaaaaaaaaaatgactgatgaagccacacacacaccaacagagtatgaaagggttgttactcacataatgaagctttctggggaaagcagggcagctcctaagcaggatttgacaacagggaaggagactgacttggagttttttggtggttagggagtagggccagagtgatgtttcttgcatgtggtttgaatttcccactggtatcaaagaaggaaacacccaggcttgcttgctttatttttttaaagagatggtgtctcactatgttgcccaggctgggctcaagtcatcttcctgcctcggcctcccaaagtgctgggattacaggcatgggccaccatgtctggcgagcacccaggctttcttagcttgccagaggtgtagggcataaggggacgaggggtgggataaggcttaaaagccaccagcagtcaaacataaattaagtcagattcttaattacagatttcagatctgatttcagatcagagcttatttcaggtcagattccaggtgtagagatcatctgaagcagtcctgggcctcttcacactacagataccaacactgcctttactcttccattagtgtcctccaaaatggggtgcatggacagcaggtacacatgaccttccaaggggtgtgggaatattagaacatctatttatatattttatttcgtccttttaagtttctgtggttttgtgtacatttcttacgttagggatttcagttcaaaattgtattgctgatagacacaattcaaaaagcttggagaccaggtacattcacaccatctaatagagatgggggaaaagatcaaaatgcttttctttttaaattttttcttagttttctttctttatagagacagagtttcgccgtgttggccaggctgttctcgaactcctggcctcaagtgatctgcccgtctcagcctctcaaattgctgggattacaggcatgaggcactgcacctcacccaaagtgctcttcttactcttacattcactcagtataacacagaaagcttctgtgaccagatgcatgggggtttttcccacacaccaagcaattctccagcagacatcagctgggggtcctataatttaattcaattctaacactatttacttggagatagcgtcagatcccacagtttaatggttcaatcctccaagactgcctcccacttccgatgccaatcacaagcttcaggttgtgacctgtacttttgaccaacccactgtaaatcggggtctctatgcctacctcttcaggtttgattaatttgcttagagcagatcactgaacccagggaaacactttacttatattttccagtttattaataaaggatataataaagtatacagatgaacagccagatggaagagatgcatatggaaaggccagcagaagtccagagcttccacaccgtttctgggtgccccaccttctaggcatgtccacctgttcagcaatttggaagctatccaaacccttttcttttggactttggctttgtttttgtttttgagacaggttctcactctgtcacccaggctggagtgcagtggcatgatctctgctcactgaaacctctgcctcccaggctcacgcaatcctcccctctccgcctcctgagtaactgggactaacaggtgtgcgccatgacgcccagccaatttttgtatttttcgtagagacggggtctcatcatgttacccgggcttgtcttgaactcctgggctcaagtgatccacccgcctctgcctttcttttgggattttatagaggcttccttatgtaggcagaattgattaaattattggtcactggtgataagttcaaccttcagcctttcctctccttcaaggttggtgttggggctgaaagccggaattctttaatcacgtggttagttcctgggcaaggagcccctatcttgaagctatccaggagcttctggcatgcagaaacccacttatcactgtcatttcattagcatacaaaaaaccatttatcactttggagattcccagggttttaggagctgtgtgccagaatactgggactaagactatctatacatactgcatatcttattatacatcacagtgt

SEQ ID NO: 1219 - DNA, 10722 bp, Homo sapiens
gcagagatacaaagattgactaattgcctcactttcttttcagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtgattgtgtccataaaaatacaatattccctaaatgttctcagaaagctaaaaatgtgaacttttactgccataaatatggttttgctaagaaaattagtttcccactttgggaggccaagctgggtggataacttgaggtcaacttgaggtcaggagttcaagaccagcctggtcaacatggtgaaaccccatctgtaccaaaaaatacaaaaattagcagggtgtggtggtgtgtgcctgtaatcccagctactcgggggggctgaggtgagagaatcgctcagactcggaaggcagaggttgcagtgagccaagatcatgctactaccctccagtctgggccactgagtgagactctgtctcaaaaaaaaaaaaaaaaagaaaattagagcttcctaagtcaaagctctttaaataacccagtaatgaaaggttcagagagtatgacaggcagagcaaaagtcatctttaaggttaagaataatatggctggaggccagacgcggtggctcacgcctgtattcccaagcattttgggaggccaaggtgggtagatcacctgaggtcaagcatttgagaccagtctggccaacatagcgaaacctcgtctctactaaaaatacaaaaattagacagggaaggtggcacatgcctgtagtcccagctacttgggaggctgaggcaggagaattgcttgaacctgggagacagaggttgcagtgagccaagattgcaccattgcactccagcctgggcaacaaagcaagactctgtctccaaaaaaaaaaaaaaaaaaaaaaagaatagtatggctggcacaatggcttatgcctataattccagtcctttgagaggccaaagctggaggatcacttaaggctggcagtttcagaccagcctgggcaacatggcaagaccctgtcaaaaaaaaaaaaaaaaaatttttttttttaattagccaggtgtggtggtacatgcctatagtcctagctactcaggaggctgatgcaggaggatcccttgtgcccaggtgtttgaggccgcaacgagctatgatcacaccactgcactcctacctaggtgacagcaagacctgtcttaaaaaaaaaaaaaaaagactacttagtaagcaagacctttttctgagaactaaaaggtaatagaatattaatttggggagtgagtttgtcatctacatgaaccatacagctaaaataaataatgcctacttacaggtagtaaataggttatttgcttctttctgatgaatcacacattgctctagatagaaatggtggtagcaaaaacttacagcaagaacaaagtaaggaaaactaatgccttacttgatatttacttcctattagtacacaaaaatatgatttcagtgttagcttttgtgaagactctccagttttggaagtagagatagcctcttcagctactttgagataagagattgagaagtgaaaatacttaacgtccaagttgtggagataatacagaattttaagggaagtgagaaaatgtaatcattttctcctcatccccacttaccaaaggttaattcctttaaccaaagaattaccaaaggtaattctcaatctttgactgcctcgacacgtatgttaagagtctctagactctctgcactgagaaacttgtctttctcagtttctcagttcaagaaagcatgcttaagacttactagtaaattacatgtaactgataagtatgtgtgtgtgtgtgtgcatacatatatatatgactgatcaaaattcacgggattgcaacatctcaactcagatctgggggctctaagcaaagaacagaatatttgcttgatagaattaaattatataatgttttatttcagtagttattttgcagcatagtcaatggtatgcatctttatgtcctctataggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatggtaagagcccatgtgtgcatacatgcatgaaggagtttgtgtgtgtgcacttacttaagatcttaggatttttttttttttttaaacggatccttgctctgttgcccatgctggagtgtagtggcacaatcttggctcactgcaacctccatctcccggattcaaggggttctcctgcctcagcctactgagtagctgggattataggcatgcagcatcacaaccggctcattttgtagttttagtagagacaaggttttgccacattggccagactggtgtcgaactcctgacctcagctgatccacctgtctcggcctcccaaagtgctgagattacagacgtgagacgctgcaccgggccagatcttaggattgtaaagtatgtgttgggaattctacatttgaagacactttaaacaaatcctttttattatgattgtattactttaaaatttaaatgataattttataaatcagattgtaagataatatctttgtccatgttagtatattagaactttattttggatatgtttgtttttaagatcaagataaattcaaggcctgcagagtgactcatgcctgtaatcccagcactttgggaggcccaggtgggaggaccgctggaggccaggaattcaaaaccagcctggtcaacatagtgatgatggcagcggcaggctctctggagcggctgcagcagggaggcacggctgaggctacacactctatggagcgggtgggagctgaagacaggtgggagtcctgccccttccgagttggcgctggagctccgttggtgccgctgcaatcgcccaagccatggctgtagtccctggcatccctgtgctctcccagtgggaacaggcgagagccccaactgcccaggcgcagctgcagcagctcaaacccgcggctgcagacctgggtctcccgctccacggagcaggcaggagccctgccttctccacacagctgcagctgcccaaaccgtggctgcggacccaggcattcctgcattcttgggggtctgggaaggcccccactgctcttacaggcttggaaatgcctgctcccactgcctggcttctccctgctgtcggcgcctgctccgatccaggagcaaagtcaggcagagcccggtcgctgtcgcagcccagccaggtgtgcacacgctcagggcactgctgacacaccagccccctgccgtcccggccccttctggatttggggcgctgacacgagcgtagaagggaagctgagcggcggctgagagcagctccccactggccttcaggcaccccttggcacctacagcctggattccgtgatcggcagcaggaggcagacaggttccggggcagaagggggcgggtttccggtgaggccccactttcgggccagggaaggcctgaaggctgggggcccagctgccaatcccacacaccagagtggaaacttgtggtgctttttccaggcccactgtgatcatcccactgcactccagcctgggtgacagagccagaccctgtcaggaaacaacagatgctggagaggttgtggaaaaataggaatgcttttacactgttggtgggagtgtaaattagttcaaccattgtggaagtcagtgtggtgattcctcaaggatctagaactggaaataccatttgacccggcaatcccattactgggcatatacccaaaggattataaatcattctgtgataaagatacacgcacacatatgtttattgcagcactattcacaatagcaaagacttggaaccaactcaaatgactggattaagaaaatgtggtacatatacaccatggaatactatgcagccataaaaaaggatgaatttatgtccttttcagggacatggatgaagctggaaaccatcattctcagcaaactatcacaagatcagaaaaccaaacaccccatgttctcactcataagtgggttgttgaacaatgggaacacatggacacagggaggggaacatcacacaccggggcctttcggggagtgggggactaggggagggatagcattaggagaaatacctaatgtaggtgacaggttgatgggtgcagcaaaccaccagggtacgtgtatacctatataacaaaactgcatgttctacacatgtaacccagaacttcaagtataattaaacaataataataaataagtaaaatatatttttaaaatttttaattcttagtaatattcagtatgtttacctatgtaattatcttttgttgtagcctgcagaattttcttcctgccccttgaactctgatgaagaagtgaataaatggttgcatttttatgaaatgaaagctcctttggtttgtctaccagtttttgtctccagagacccagtaagtctgtgtctgttttttatattatactacaatgataatgcttgatttttaggataatctttaagaactaggcacttttgtgtttgttgttgttgttgttttgagacagagtttcactcttgttgcccaggctagagtgcaatggcaggatctcagcttactgcaacctccgcctcctgggttcaagcgattctcctgcctcagcctcccgggtagctgggattataggcatctgccaccatgcctggctaatttttgtatatttagtagacggggtttcaccacgttggtcaggctggtctcaaaccactgacctcaggtgatccacccacctctgcctcccaaagtgttgggattacaagcatgagccaccatgcccggccatgtgttgttgttatttaagaatgagggtagcctctagaattattttggaagataagggagctcttcaccatcctatgagttaggcagagcagattttacctttgagaaaatgaaggcacaagcattttaaataacacccaaaattattttattaaatagcaggtgtagttgggcatggtcacatgccccagtattcttagctactgaggaggctgacttgaacccagaagtttgagaccagcctgggtaacagtataatccccatctcaaaaaaaacaattagtagagtcacaactaggattcaggtctcctgtcatcttgtttggtgttcattatattataatactatacgctagaaaaaatattacagaccaattcaaagcaaatacctactaaaatattggtcatatcttctcttttttttattttttgtgacagagtctcgctctgttgcccaggctggagtgcagtgatgcaatctcggctcactgcaacctccgcctcttgggttcatgtggttctcctgcctcaccctcctgagtagctgggattaccggtactcaccaccacacccggctaatttttgtattttcagtagagacagggtttcgccatgttgaccaggctggtctcgagctcctgacctcaagtgatccgcccgcctcagcctcccaaagtggtgggattacaggcatgagctactccgcctaccctggtcatatcttgatccagtgattacatgcctaggatattatacttaaatatatgcataattgtgtaaaattactagttaaaaggttattattacagtattgttgtagtagcaaaagaattagaaataatgcaagtgtcagttgagaagttacatacgcaatagaataccatgcaggtataaaagaatgaggaagctcttttatgatttcatatacaaagatctcaaaactatattgttacatgaaaaaaagttacatgcagaaaagtgtgtacaaaatactacatttgagtaaaaataaaagtaagtatttatggaaggatatacaagaaaatgcttacactggttacctgctaggaaggggagtgagtggtgagggcaagagagaagaagatacattttactgaatacatcgttttgccccctttgaatttagaacatgtgaatgtattacctatttaaaaaataaaaactattgcaacgtaaaaagttatccctcccccttaaactctaatcaataatttgagtactaacatattgtttgtctgttatcttaggggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacctccagacaaaataatattaatagtctatcatttaacaaatatgtattgaacacctacccttctctctggagtgtacacttcatgtgggcaagggccttgttcacgactgtagcactagtgcctttaactgctagcaaagtagccactcggatgattataccaaacactttactaaagctggggatctgtctagtggggaagacaaacaataaatatataatatgtcaggtggtattaaatgctatgaaaagaaaggagtagatggactgtaaaggaggatgctatttttttgtggccatcccgcactgagacaggatgcattccacactcaaaatttggttcacatgtccagactgatagccaagttcagtggctcacgcctgtaatcctagtacttagggagaccaaggcaggaggatcacttgaggccaggagttcaaggccagcctgggcaacagagagagacccccatctctgcaaaaaaagaaaaaaaattttttaattatctgggcatggttgtgcacacctgttgtcccagctgctcaggaggctgaggcacgagaatcacttgagcccagaagttggaggctacagtgagctatgattgtttcattgcactgtagcctgggcaacacagtgagaccctgtctcaaaaagaaaaaaaaaatgactgatgaagccacacacacaccaacagagtatgaaagggttgttactcacataatgaagctttctggggaaagcagggcagctcctaagcaggatttgacaacagggaaggagactgacttggagttttttggtggttagggagtagggccagagtgatgtttcttgcatgtggtttgaatttcccactggtatcaaagaaggaaacacccaggcttgcttgctttatttttttaaagagatggtgtctcactatgttgcccaggctgggctcaagtcatcttcctgcctcggcctcccaaagtgctgggattacaggcatgggccaccatgtctggcgagcacccaggctttcttagcttgccagaggtgtagggcataaggggacgaggggtgggataaggcttaaaagccaccagcagtcaaacataaattaagtcagattcttaattacagatttcagatctgatttcagatcagagcttatttcaggtcagattccaggtgtagagatcatctgaagcagtcctgggcctcttcacactacagataccaacactgcctttactcttccattagtgtcctccaaaatggggtgcatggacagcaggtacacatgaccttccaaggggtgtgggaatattagaacatctatttatatattttatttcgtccttttaagtttctgtggttttgtgtacatttcttacgttagggatttcagttcaaaattgtattgctgatagacacaattcaaaaagcttggagaccaggtacattcacaccatctaatagagatgggggaaaagatcaaaatgcttttctttttaaattttttcttagttttctttctttatagagacagagtttcgccgtgttggccaggctgttctcgaactcctggcctcaagtgatctgcccgtctcagcctctcaaattgctgggattacaggcatgaggcactgcacctcacccaaagtgctcttcttactcttacattcactcagtataacacagaaagcttctgtgaccagatgcatgggggtttttcccacacaccaagcaattctccagcagacatcagctgggggtcctataatttaattcaattctaacactatttacttggagatagcgtcagatcccacagtttaatggttcaatcctccaagactgcctcccacttccgatgccaatcacaagcttcaggttgtgacctgtacttttgaccaacccactgtaaatcggggtctctatgcctacctcttcaggtttgattaatttgcttagagcagatcactgaacccagggaaacactttacttatattttccagtttattaataaaggatataataaagtatacagatgaacagccagatggaagagatgcatatggaaaggccagcagaagtccagagcttccacaccgtttctgggtgccccaccttctaggcatgtccacctgttcagcaatttggaagctatccaaacccttttcttttggactttggctttgtttttgtttttgagacaggttctcactctgtcacccaggctggagtgcagtggcatgatctctgctcactgaaacctctgcctcccaggctcacgcaatcctcccctctccgcctcctgagtaactgggactaacaggtgtgcgccatgacgcccagccaatttttgtatttttcgtagagacggggtctcatcatgttacccgggcttgtcttgaactcctgggctcaagtgatccacccgcctctgcctttcttttgggattttatagaggcttccttatgtaggcagaattgattaaattattggtcactggtgataagttcaaccttcagcctttcctctccttcaaggttggtgttggggctgaaagccggaattctttaatcacgtggttagttcctgggcaaggagcccctatcttgaagctatccaggagcttctggcatgcagaaacccacttatcactgtcatttcattagcatacaaaaaaccatttatcactttggagattcccagggttttaggagctgtgtgccagaatactgggactaagactatctatacatactgcatatcttattatacatcacagtgt

SEQ ID NO: 1220 - DNA, 1930 bp, Homo sapiens
actcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtcacttgagaagaaagggagaagttcctatgaggctgtcggaaagggaaatggggccctccgcttgttgaaaacaaaacaaaaccctcaggaagctttgcatcctgttagtcatagcttaaatttatgacttcaatgactt

SEQ ID NO: 1221 - DNA, 3511 bp, Homo sapiens
tccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggcctgtagtttaaagctaaagcatgtaccaatttttgaaaagttcagggattgtgaaatgtgttttaggcataggtccaggatttttgacgggacaaatcttagtctctttcagttagcagtggtttctaaggaaaaagtgctatacttctttttgaatatactctttgtgacttttgccattatctcttaatttctcaatagtgcagtgaaaacaatttctataaagccacagtttcagcgcagtaatagattagtgttacataatataagacctaatgcttacctcaatatctacttatccgtacctatttgaaataaatcatgactgtttcatcttagaaaaatatttgattccatattcaggtatgtatgtatacaccagatgatgtgtatttaccactggataagtgtgtgtgctggctgatgacccagggttttggcgtagctcttctatgctcagtaaagatgatggtagaatgttctttggcaggtactgtggattagaattaattatcttgtataaatgctaggttcacttctcagggaatcttactctaagacataagatgtgcgtgtacatggaaaacaactctaaagaggcaagggttgtttttattgactaatagtccacacactattataactcgaatattagtgtactttagacagctttatttctaacacagtgctgtttctgacatattggaccattaacagggtaggaagtatttatggtggttttttggttctgttttgcttttggttagtttgtttttgtttttctctgaaagtgatccatgatctctaaccttgctagattataatgccagaagctctggaattctggcttatcggaggcaagctgtatcttcaaattagtttatcccctaagctatcaggttgattgaaattattataatattggtgaaattctttcatccttcatgatcctgtgtaaagcttatatctgctcattgatacagatggctaaaaggccagaaagacacacatttacccatgtaacaagcctgcacatcctgcacatgtaccttcgaaattaaaatgaaatgaaataaaattaaaaggaaaaaaatgccatggcaacatcaggaagttatcttttatggtctaaaaatgggcagcataaataatctaccccttgtttagcatactattgaaaaataacaataaaaatcggcaaccagtagcccttgcgtctactctgcctatgaagtagccattcatttattccttcaattttttataaacttgttttactaaaaaaaaaaaggacaaagaaagaaagtgcgaattgtgaaatggtagtgagtgatggcatttgaagtgggtcctttatgatttgatggagccaggcagaagacgtttggagaaagaagttcctgaaagtaggaagggcatgtggaaaactctgaggctgaggaaaaaaaagaaagaaagaaatataaagaaagaacttgacatttcactgtatataaacacattacaagcctaaagtacgttgaagaaaaaatagaattcaaagttagacagaagggctcaggcttactatttgcatcttacagatgagagtagtagagttggtattttattctgaaacacagaggacaagtggagatttgtaaacctgagataaacatggtttctaatccactgaacaccgaagcttatttttttctctttcttcatctgccttacttagtgcaaggtgctataacaaaatagcatagactgggtgacttcaacaacaggattttttctcacttttctgctggttcctggtcagggctctcttcctgggttgcaggtggctgacttcccactgtgtcctcaccagaaggaagagaaatggctaatctctctgcttctgatgaggaaaataattctatgatggggatctgctctcatgagctcctctaaacctgattacttttccaaagcctcccccacaaatggagccaattgggagttggggattcagcatgtgaattttctggagacacaagcgttaagttcataacaccatcacattaaactaaactcttgcttattaacgtgcattaactttcaattatataagaactccagtgaatctgccttctcaattaatgttatacaaattcttcacactatattttcatctgaccgtgctgttctgctgctgagacatgacacgctgatgctgacttgtgagcttctgctggctcatttccttcacctaagtccccacctccctagaagcttacaatgaggtctcctccttgaaatgctgtgaccagtctgtagacttaagggtatggga

SEQ ID NO: 1222 - DNA, 4915 bp, Homo sapiens
tccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggcctgtagtttaaagctaaagcatgtaccaatttttgaaaagttcagggattgtgaaatgtgttttaggcataggtccaggatttttgacgggacaaatcttagtctctttcagttagcagtggtttctaaggaaaaagtgctatacttctttttgaatatactctttgtgacttttgccattatctcttaatttctcaatagtgcagtgaaaacaatttctataaagccacagtttcagcgcagtaatagattagtgttacataatataagacctaatgcttacctcaatatctacttatccgtacctatttgaaataaatcatgactgtttcatcttagaaaaatatttgattccatattcaggtatgtatgtatacaccagatgatgtgtatttaccactggataagtgtgtgtgctggctgatgacccagggttttggcgtagctcttctatgctcagtaaagatgatggtagaatgttctttggcaggtactgtggattagaattaattatcttgtataaatgctaggttcacttctcagggaatcttactctaagacataagatgtgcgtgtacatggaaaacaactctaaagaggcaagggttgtttttattgactaatagtccacacactattataactcgaatattagtgtactttagacagctttatttctaacacagtgctgtttctgacatattggaccattaacagggtaggaagtatttatggtggttttttggttctgttttgcttttggttagtttgtttttgtttttctctgaaagtgatccatgatctctaaccttgctagattataatgccagaagctctggaattctggcttatcggaggcaagctgtatcttcaaattagtttatcccctaagctatcaggttgattgaaattattataatattggtgaaattctttcatccttcatgatcctgtgtaaagcttatatctgctcattgatacagatggctaaaaggccagaaagacacacatttacccatgtaacaagcctgcacatcctgcacatgtaccttcgaaattaaaatgaaatgaaataaaattaaaaggaaaaaaatgccatggcaacatcaggaagttatcttttatggtctaaaaatgggcagcataaataatctaccccttgtttagcatactattgaaaaataacaataaaaatcggcaaccagtagcccttgcgtctactctgcctatgaagtagccattcatttattccttcaattttttataaacttgttttactaaaaaaaaaaaggacaaagaaagaaagtgcgaattgtgaaatggtagtgagtgatggcatttgaagtgggtcctttatgatttgatggagccaggcagaagacgtttggagaaagaagttcctgaaagtaggaagggcatgtggaaaactctgaggctgaggaaaaaaaagaaagaaagaaatataaagaaagaacttgacatttcactgtatataaacacattacaagcctaaagtacgttgaagaaaaaatagaattcaaagttagacagaagggctcaggcttactatttgcatcttacagatgagagtagtagagttggtattttattctgaaacacagaggacaagtggagatttgtaaacctgagataaacatggtttctaatccactgaacaccgaagcttatttttttctctttcttcatctgccttacttagtgcaaggtgctataacaaaatagcatagactgggtgacttcaacaacaggattttttctcacttttctgctggttcctggtcagggctctcttcctgggttgcaggtggctgacttcccactgtgtcctcaccagaaggaagagaaatggctaatctctctgcttctgatgaggaaaataattctatgatggggatctgctctcatgagctcctctaaacctgattacttttccaaagcctcccccacaaatggagccaattgggagttggggattcagcatgtgaattttctggagacacaagcgttaagttcataacaccatcacattaaactaaactcttgcttattaacgtgcattaactttcaattatataagaactccagtgaatctgccttctcaattaatgttatacaaattcttcacactatattttcatctgaccgtgctgttctgctgctgagacatgacacgctgatgctgacttgtgagcttctgctggctcatttccttcacctaagtccccacctccctagaagcttacaatgaggtctcctccttgaaatgctgtgaccagtctgtagacttaagggtatgggattaatttcacctctttaggcatgcgtcaacacttaaaatgaaaagttccttagtaaagtaaggatcacttcattgtagttaccgtggaaagaaaaacctgtttcctgctctgatctctaacacctcaacctccctgtagagcctcacaagggctgagaaaagccagatgccgttggaaatagtattgcccctaataaaatagaatggctatccctgcctaaaccttgacttcctaaagcttggaacactttttcttcgttgagccccttcctcgctgctgtgctgcaatccagggaagggggttcagcccccttcactgaacctttccccatctcttccaaaacatctgtttctgaggagtcctgtcctatagaggtctttcttccaaccagatttctcctgcaccttttactcccacttgcagaactcccatgtacaagtttctttattgcctagttcttttatttgctcatcaaaacccacatctaacgtaaacaaaaaagtgtggagtgtgcacatgacacaaacacacatagccatgtataaatacacataaacacatccctcaacataaaaccctttgtggctcatatatttaaaaagacataaaaaaagaactgaagacaaccatgtgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgctttcccattaaatgcaggtagttgttcttcttgcagcactagtcactggccataatttaaatcttgttatcttcttgccaccatgaaccctgtatgctgtaggctgaaaacgttaaaagaaacacacgctctcacacacacacaaacacacgcgcgcacacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaatgaccatacttgtc

SEQ ID NO: 1223 - DNA, 1750 bp, Homo sapiens
agacagggacataaaagttgcatgtaatggaaaaaacatatcttattgctagatagaagaacaagaacagtaccagcacttagggaggcaaagccaggatgatcacttgagcccacgagtttgagaccagcctgagcaacgtagtgaaacttcatctctaccaaaaaattttaaaaataagcagagtatgatggtggacacctgtggtcctagctactcaagaggctgagacaggaggatcacttgagcccaggaggccgaggctgcagtgagccctaactgcactacctcactccagcctgggcgacagaaccaagaccctgtccccccccaaaaaaaaaagatgttgggaagactttactcctcatagttaacaaatttattgcaaattaattaaaaatcaatgcaaatagaatagtaggagaacttagtaaaacagtttatctttaaaataaacatggaagtgtggctggacatatttgaaaaataaaagtaatgggtttactgacatgataataaaatgtagcaatgcaggaaaaaagaaagagatgaatagaaagcaataggcaggcagaaacagatccgagtataaataagaatttatcctgggtgcagtggttcatgcctgaaaccctaacattttgcgagttcaagatggaagccagggatttgagactagcctgggcaacataccaggaccctgtctctaaaaaaattaaaaattagttgggcgtgatgtgtgcgcctatcagcttgagaggctgaagctagaggattgcttgagcccaggaggttaaggtggcagcaagctgtgattgcggccctgcacactagcctaggcaacagagcaagaattcatcttaaaagaatttagtagatgataaaggtattattttaaattagtggagagaaggctgtctgttccaattaataatgttgcctgatcatttggagaaagtcactctagattctttccctcatactgagcaccaaaaaatatataaattttaaatagattaaaatgttaaaaattttgaagtatgtgtttattaaaagaaagaggtgtatttacataaagttatgacaaatgacaagtcctaagagtttgcatttaagttttatcaactaaaattgctgaatttcacaaaattaaaattcctagaattttaagtgtgataagattgtgaagatagctcaagggagtgtgtctataatatgcagaaatcacttctggatttattcctaataatgtatccagtatcacagtatcacctgtatttccctgtttataacaaaactggcatcatgatgattagtaggccttaatagtgaaaaggctttttaagtacacaacaaatgtttctgtacttgctccgattgccccattgcttgtacttctgtagtacttgtgagccataggatcttttctcaaaagccttgataaagaagttttataaacttataagatgatttaatgtagtaccataaaattaactgtagcagtaggctttttcaggaagacatgtgaaataaaaaaaattagcaaggtgtggtagcgcacatctatagtcctagctactcaagaggctgaggcaggaagatcattgggtcccaggagttagaagttgcagcgagctgtgattgcgccactgcactccagccagagcaacagaacaagaccctatcctgtccctaaaaaacaaaaaacaaaatgtgttttataagtgattataaaatgtttttttcatag

SEQ ID NO: 1224 - DNA, 215209 bp, Homo sapiens
agtgtatgtttgttccttaactaggtttgtcatctagcctcttcaaacctatttctgtggggccaagccaggagtaattttgcaggttgagcccaaaaggtttttttttttttttttttttttggtggttcatggtgtttttcttttctttcttcacaggatgttgtgttatgcacagctgggaagggcacataagacccacacggaaaccaaacacaaagggtaagttggccagagagaatgcagatgcctgaaggggtagagaaagttttctccccggggaaacatcccaggaagctgagcctcatccagatgcttgctgggagctagttagcggcagagcaagggttaacatgcaagtctcctgattctcacttcaggctctttcctttgtgcttagaattgctgtgtgatctcagataagtcacataacctctctgaacttcagtttcccaagctgtgaaatacagataacaatagggatgttgtgaaactttaattcaaagaggtagctttggaaaccacctggtatgtagtatgagctttataaatggtagtgtagtgagagtagggatggaatttactcaaactacaactcaatgtgcaaaaaaaaagtgacttctttatgttttgttaaatactctcatctacataaactcttgctggataaaggaagaaagacattgtcagttcgtagttgttgatatggtttggctatgtcctcacccaaatctcaccttaaattgtaagaatccccacgtgtcaagggcggggccagttggagataattgaatcatgggggatggtttcccccatactgttctcgtggtagtgagtaagtctcacgagatctgatggttttataaatgggagatccccgcacaagctctcttgcctcctgccatgtaagtaagacataattttgctcctcatgattgtgaagcctccccagccatgtgcaacagtgagtcaaattaaacctcgttcccttataaattacctagtctcgggtatgtctttattagcagcatgaaaacagactaatacaactgttcccagtgtctctgtttcctggttcttctttgggcaacttagcaacttggtctatattgtgttaacagctcatctttcacattttttttttttttttgagatagattctcgctctgttgcccaggctggagtgcagtggtgcgatctcggttcactgcaagctccgccttccaggttcacgccattctcctgcctcagcctcccgagtagctgggactacaggcgcccgccaccacgcctggctaatttttttgtatttttagtagagacggggtttcactagaaaccaggctggtcttgaactccttaggtgatctgctcaccccagccttccgaagtgctgggattacaggcatgagccactgcgcctggcccctttgtaggactttttcaaaagggctttattgagatggttgggaaaattttctcaaggaagtgatgttccagtggacttaaaggatggatgaattgatgttacccaggcaaaggggcagggtgggatagggcatgtctggtggccagaacggtgggtgcaaaggtcctgaggttggaaagaatttggaggaccgagcgaaggtgagtgtgactgatgacacagggcaggagatgagatggggaggtggacaggtacctagtcccacaagaccgggttgttactctgaccttggtgggtttcagttgtgagggagagggctagtggaagagaatgatgggaaacttacagcattaagagaccacaagtgataaaatgccggaagtctgcatagagaaatgttgcctctacagatgaaagaggaagctggaaatgagaagagagataccatctgaggcctcatgcagggaagggaaataaacaaggcacattataggagcaaagaacgtagatctcaaaaccaaatgtgtaacaaaaacagggtgaataatgtcacaatcacgataatccattccttctgtttttatgatactttttagtttttccatactcctaattgatgttggcattatcgttggttcctctcttttcactcctcacatccaatccatcggcaaattttgttagtgttgctttaaaaaaatcctgaattgcattcccttcattgattccctctgggttgtatctactgacatctttcacctggacaagtgcagtcaccccctccttggtcagtttatttctgatcttctatagttcgtcttccaaccagtggccagaaggctcatgttaaaaccttatgttgtgtccctactctgctcgaaatcctcccatgactcccatctttctttgataaaaaacccaactccactattcacaatagtcaagatatggaatccacctcagtgtccgtcaacagatgaatggttgaactcaatgtggtctgcatacacaacggattgctattcggccataaaaagaatgacattccacaatttgcagcaacatggatgaaactggaggtcattaagtgaaacaaaccaggcacagaaagacaaatgtcacatgtcctgactcataggtagttgccctactgtgctactgagcactcgatctcattccttccatctaactgtggtttttgtaccaaccagtcaatccctctttatcccccttccccactatcctttccagcctctggtaattgtcattctgctctctacctccattagataatgatgatgatgatttttagctcccacgtaggaacgagaacatgcaatatttgtctttctgtgtctggtttatttcacttaacataatgtcctccagtcctccagttccatccatgtttctgcaaaggatgggatttcattctttctttctttttttattttttatttttttgagacggagttttgctcttgttgcccaggctggagtgcaatggcgcaatcttgggtcaccacaacctccgcctccccagttcaagtgattctcctgcctcagcctcctgagtagttgggattacaggcatgaaccaccatgcctggctaatttttttttatttttagtagagacgggggcttcttcatgttggtcaggctggtctcgaactcccgatctcaggtgatctgcccgccttggcctcccagtgtgctgggattacaggcgtgagccatcacgcctgcccgatttcattatttcttatggctgaatgatattctattgagtacatatacgacatcttcctcacccattcatccactgatagacacttaggttgattccatctcttgcatgtactttggattttgaaaggtctggctctgctgctctccagcagatgtggttgtgtgtctttgggtaagtcactcaacctctctgagtcatgttttattttcacatatgggtattgggaatggtgcccatttcctgtggctgctgtaacaaattgccacaaacttggtcgcttaaaacaaaaaaaacttacctatcattctggaggtcagaagtctgaaatgggtcccactgggctaaaatagaggcaatggcagggctgcgttccttctggatgctgtacggaagaactattttcttactttttcctgtatctagggtcaaccatgtttcttggctcatgtccccttcccccaacttcaaagccagcagtggctggccagctctttcttacatcacatcactctgacaatgcttttcttggtttcagctttcacttataaagactcttgtggttacattcattgcccctggatgatccaagataatatgcccatcttgagatcagcatgattagcaaccttaattccatctgcaaccttaattcctccttcgccatggaccataacatattcacaggttccagggattaggacatggtcctcttggaagggtctgttattctgcctgccacaaggatgacagcagcaagtgagcctctttcctagcacctgggagcctgctcccacctgtggtcttgtccttttgaagctcacagtgtggtggtgaaggtggccatgaaggagcaactcactgaaacaatcaagcagtcacggttttgatgaattccataaaagaagagctcagggagctgtggaggagtcagggaaggcttcctggaggaagtgatgctaaagcaagatctgaaaaatgagtggaagctggccaggcaaagcagaggcagagggaacagcatgtgcaaaggccctgtggtaggaaggctagaaatggagtgcaaagagaaactgacatgatgaggctgaatgatgtggttgggtctggtcactgggggctttgcagttcatgttgagtaatttgagttttatttctaaggagaacaaagagcattataggcaaggggtggaggtgggagatcaaatgtgcattcagagatgaccatggtgtggagtagaagattgtggaggacaatggggtatatagaaatgttaaattcagaggaagatctggatcaggcatagccaaggtggtggggttaaatgggtaattgtcaaattatatttgggaagggggatcaacagggcttggaggcttattaaatgtggtggctaaacaggcaacctgaggtacagacacgtgaaatcacttgtcccaagactggattggctaggatagagtgttgattgtttccatagaaacaaaataactatgaatgaaacaatgcagatgtttatttttatctgtctcataaatctccaacttgaagatggaacagcgtcgtggaacaaccttgcctaggaggtcattccatctcccaggtgccttttgccttgttgcctctccaatcttaggcgtgagcctcatccccgtggttggaaatggatcaccccagtctgtccatcttccagcccatgtgaaaagggagaaaaagtgtggagtatgctctttcttttcaagggcatgaccagacagtacacacatcacttctattcattctccttggccagattttcaccaggtggccacagctagctgcaagagaagctgggaatgcagtcctaaactggatggttctattattataaggaagagggtggaatggatttgggggaacagccaccattcttggctttgaggtttgctgctggaacttgaactcagatctgccttgtcccgaaatttgcagttttcactctcacacttttctgtctagtgcttggatgttcatggtgtgatccatggagcaacagaattggcatcctccaggcacttgttagaaatgcaaaatccccggcccccttccccagacctgctgaattagtacctgattttccaagatgttcttggaatccaaggggaggcaggtgatactggtctgtggatactttgggtagcaaggatccagatgagtgcttctcaaacttccctgtgcgcacacatcacctgggatcttgttcaaatgcagattctgattcaatggattttgcatttccatctaactcccaggagatgcttatgtggctgactcacagaccctactctgagtagaaagggtctaggatctttgaggtacatggttaaatatgattggttgctgtatccgtttcctagggctgcttaaaatgacagaaatttattctcttcaagttctggagtccagaagtgtgaattcaaggtattggcagggccagtctttctccaaaggctatagggcagaatctgttccatgcctttttttaaggcttttgttattgctggcaatccttggtgttccttggcttctagacatatcactctgatcccggtttgcactgttgcatggcactgtccctgtgcatgtctgtgtgtctcttctcttcttataaggacacctgtggcccaccctactccagcactacttcatcttaacttttatcttaattgcatctacaaagacccagtttccaaataagatgaaattcacaggtaccagggtttaggactgtaacgtatcttttgggaggaacacaatccaacccataacagtcacctccacccttgtatgctgggttcccttgcagcctcactctaatgctctaatcttgtctaaacttttctttatacactgcctaggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaaggtgagttcatgtcccctcaaaccatccagcatttggtaggaaaatcaagtcaaagctggctgggtattgaatgtaggtactcccccaccccccatttttttttaaatctggtttaactatatattttaagtggagtattaggtcatttctgttcaaggttaatattgatatgtgggggtgttgttactgtcacagcattgctagctagtgttgctagcaaacatgattttcttccttccttccttccttccttgctacttccccacccttcctctctttgatcatgtaaataattcctggtcactgtaaaatttcatggatggttgagtttcctcacaatatggtggctggattccaaggataagcatcccaagagaacaaggtagaactacatgatatttttatgacctagtgtcacttccaccatagtcacaagtatgctcagattcaagatggggacataccttccattgcttgacagaagaagtaccaaagtgaagtgcatatgggatgggagatattgttttaactttttttttttttttttttgcaaaatacagtcttctatctagtataagtaaatttgtaactccaattctctgtctagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactggtaatgctctcaggttcccagggatgggtcttgggtggatatctatcagtggggtgagttcatgtatttctgaactgaggcacccaatttcttatctgctcaccctcttccactgcttctcagatatcaatgagtgcctcaccagcagcgtctgccctgagcattctgactgtgtcaactccatgggaagctacagttgcagctgtcaagttggattcatctctagaaactccacctgtgaaggtatccatgaccatctctttattatttacctacttaattaattaagggtcatctcactggaagaccatatgagaaagggattttctcatgtagggataagaaaattggggctcagagaggtaaaaatatatagttgcttatatctttttctatccctttactttgagcctgtgggtgtctttacatgctaggtaggtctcttgtagccagcacatggttgggtctttttaaaaaattttttatctggtttaacaatctatatcttttaagtggagcattaggccatttctattcaaggttaatattgatatttgagggttttgttcctgtcacagcattgctagctagtattgctagcaaacatgatttccttccttccttccttccttccttccttccttccttccttccttcctacttccccacccttcctctctctgatcatgtaaataattcctggtcactgtaaaatttcatggatggttgagtttcctcacaatatggtggctggattccaaggataagcatcccaagagaacaaggtggaagtacatgatatttttatgacctagtgtcacttccaccatagtcacaagtatgctcagattcaagatggggacgtaccttccattgcttgacagaagaagtaccaaagtgaagcgcatatgggatgggagatattgttttaacttttttttttggcaaaatacagtcttctatctagtataagtgaatttgtaactccaattctctgtctagatattgatgaatgttctcaaagcccccagccctgtggtcctaattcatcctgcaaaaacatgtcagggaggtacaagtgcagctgtttagatggtttctcttctcccactggaaatgactggatcccaggaaagccgggcaatttctcctgtactggtgatgccctcaggttcccagggatgggtcttgagtggatatctatcagtggggtgagttcatgtatttctgaactgaggcacccaatttcttatctgctcaccctctttcactgctttgcaaatatcagtgagtccctcaccagcagcgtctgccctgagcattctgactgtgtcaactccatgggaagctacaattgcagctgtcaagttggattcatctctagaaactctatctctttattatttacctgcttaattaattaagggtcatctcactggaagaccatatgagaaagggattttctcatgtagggatgagaaaattggggctcagagaggtaaaaatatatagttgcctatatatttttctatccctttactttgggcctgtgggtgtctttacatgttaggtaggtctcttgtaggcagcacatggtttggtcttttttacaaaaatttttatctggtttaacaatctatatcttttaagtgtagcattaggccatttctgttcaaggttaatattgatatttgagggttttgttcctgtcacagtgttgctcgctacttgctttgtgatctcagttgtgtaattgctttataggatctgtgaactatatgcaaatattaagtggaagagctgggatttgaactcctgctgaggacctactataagtcaaacaatggtatcagaatataatggggtgcacttgtctccagaccgatattttccccaggggacattggcaacatctggagatatttttgattgtctcaaccggtgatggtggggagaggtgctgtgtatggcatctgatgggaagaggtcagagatgctgctaaacatcctataatgcaccgaaaggcccccacaaccaagaataatctgaccctaaatgccaatagtgctgaggtggaaaaaccttattctgggctgggcgcggtggctcacgcctgtaataccagcactttgggaggccaaggcggatggatcacttgaggtcaggagttcaagactagcctggcgaacatggtgaaaccttgtcgctactaaaaatacaaaaaattagccgggcatggtggcaggcacctgtaatcccagctactcgggaggctgaggcaggagaattgcttgaacctgggaggcggaggttggagtgagctgagattgtgccattgcactccagcctgggcaacagagcaagactctgtttcaaaaaaaaaaaatacccaacaacaagaagaacaaaacacacaaaacctattctggggagattctaaagtctaaacttcagaacgttcccctaaaaggtatttgaattaacagttgaaagttatctttaatcagccgggcgcagtggctcctgcgtgtaatctcagcactttgggaggccaaggcaggcagatcatgaggtcaggagatggagaccatcctggctaacaaggtgaaaccccgtctctactaaaaatacaaaaaaaaatagctgggcctggtggcacgtgcctgtaatcccagctacttgagaggctgaggcaggagaatggtgtgaacccaggaggcagagcttgcagtgagccgagatcacaccactgcgctccagcctgggtgacagagcgagactccatctcaaaaaaaaaaaaaaagaaagttatctttaatcttttctctcccttcacattaaagcagtcatcacaccttggagaatctacctgctaaatatgttttgagactgggtgtggtggctcacacctgtaataccagcacttagggaggctgagatgggagaatcgcttaagaccaagagtttgagaccagcctgggcaacatagtgagaccctgtctctacaaaaaaaaaaaaaaaattagaaaattagccaagtgtggtggcatgtgcctgtggtcccagctactcaggaggctgaggtgggaggatcacttgaaaccaggaggttgaggctgcagtgcactatgcttgcatcactgcattccagcctggataacagagcaagaccttgtctcaaaaataaatatataaataaatatgtgttgaattcctccactgttttccatccttggttcaggcttgatcatcactgcagcagcctcctctctagtcttgcctttttcagtcttattctctccaatccatcctctacactgcagccagaatgtcctcaccaagagacaagagctccatcttcctgtgtctagtgcattgttattctccacattcatttatgggatggtgactccattgagaaaggcaaggagtggtcaagccctcattatatccccctggcttagtttaagagatgtttgaaatcatctctgcctttgctactccatttgtagcagtgagctatcactgggtaacaaattgtcttaaaaattagtgtctaaaaacaaccaccatatatttagcgcttgattccatgagttgacattttaagtggtctattctagccagatcttttggtctcaactggtcttgttcttgtgtctgcagtcagctgaccttggctgggcttttgtcttgttgcctctgccaccttaggtgtgagcctcatccccatggttgggaatggatcaccccactctgtccatcttccagcccaggtgaaaagggagaagaagtgtagagtatgctctttcttttcaagggcatgaccagatggtgcacacatcacttctatttattctccttagccagattttcaccatgtagctacacctagctgcaagagaagctgggaatgcagtcctcagctgtattgttacattattacaaggaggagggaatgggtctcacatgtctggggctcatctgggatgattcatttctctcccatttggtcttttgttcttcattaggctagtcaggggcttgttcatatggcagagatcagaggcccaatagaatgaacagaagccaacaggtctcttgaggcccaggtttggaattagcacctcattacttcactgtcttctattggtcagtgcaagtcgtagggccagctgtatttaaggggtagagaaacagactccacctcttaatgcaaggtatggtaaagtcacatctcttacaatctacatcttggggtgtaaatacagagagaagtaaaggactatggctacttttccaatttctgataattatgttttgaaactatttgccacccttctgcttacatgctattggctagaatttgctctcatggccatgcctactgaaagaaggaactgggaaatatgtcccactgtgtgcctgggaagaaggggggaacatggatattggggagcatcagccctgtctgctgaaaatcaacactcagagtgcatctcctatttgtagtctctactccttgctttctcatttaccttgacctgggttttctcttccactcttcagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaaggtaggtgggggtgtcttctgagaagtcaggtccaagtctgtttgaaaagacagcagtgaggggattagggtgggtcttggttgagtttgagactttcatctgcaaatctgaagccaataatcattcattcactcattaaagaaatacctcttgagcacttacagtatacgtggcactattctaggcactggggatagagcagtaaataacatctccaaataacatcccactggggcttagggcttccatataggaatttggaggaggggcaccattcagtccatagcacccatgaacaaacagcttgtaagtgacagagccaggctatgaacccagaatgtccatgttctcaacccctccactgtgtgcctctttttgtttgtttgtttgtttgttttttgtttttttggggtttttttgttttttggttttgttttgagatggagtcttgctctgttgcccaggctggagtgcagtggtacaatctcggctcactgcaacctccccctcctgggttcaagcaattctcctgcctcagcctcccaagtagatgggattacaggcatgtggcaccatgtccagctaatttttgtatttttagtagagacaaggtttcaccgtgttggccaggctggtctcaaactcctgaccccaggtaatctgcctgcctcggcttctcaaagcgtttggattacaggcatgagccactgcgcccagcctgttttttgtttttgagacggagtcttggtctgtcgcccaggctggagtgcagtggcttgatctcagcttactgccacctctgcctcccaggttcaagcaattcttttgcctcagcctcttgagtagctgggattacaggtgtgtgccaccatgcccagctaattttttattcgggacaggtaagccccaaagtggggtttagctcacaagggttcttggctttgcccaggagagaattcaagggcaagccagaggtagaagaaaacagctttattgaagaggcagtgttgcagttctgtaagtgttacagctcctgcagagcagggctacttcataggcagagagcagcagctcagggcagttttgcagtcatacttatacctacttttaataatatgcagattaacaggtggtttatgcaaaaatttctagggaaggggtagtaacttttgggtcattgagtcattgccatagaaaggggcagtaactccccaatattgccatggcaatggtaaactgacctggcacactggtgggcatgtcttatggaaagctgcttccactctgtccttgttttagctagtcctcaattttgtccagtgtctgagtccctcatctggagttgagtcctgtttcctgcctcattactagcttagcataatagaaatgtatcactctcataataattcaatatggatatacctggctggtgggcagcttttctccacatggtgataaaggagttcaatctctctccatcttttggtttttgcattccttagagccttggtgttcctggtttagccagttgaggtgaaagagggaggagagaagtcacacccacttcttgaccaccttggccctgaagtgacatatatcatggctctcatattccatgagtgaaaagtagtcacatgacctcacctagatgcagagggttctaggaaatgtagtccctggctgggacaccattttctagtgaaacatgactccatattttgcaaagggaagcatgattttgttggctcattggccaacttggctccacacccattctgtaccccacagatattgatgaatgcactgaaatgtgccccatcaattcaacatgcaccaacactcctgggagctacttttgcacctgccaccctggctttgcaccaagcaatggacagttgaatttcacagaccaaggagtggaatgtagaggtgagcagagagtttgatggacaatccagaaaagacatttctctttgctcttctgggtttcttgatattctccagttctttgcagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagtaataatctctttgtatgtcttggcaatggaatctgtttctggctttggttggaaaattctcattctacccaacctcgggatcttcctcttagtgttgcctcatccacatattctgtttctttttcttcttcatccatttactctttcaacaaatgatttttggagtacctattaattaattagttaaacaggaccctgcagtaggcactgaagatttggtcctgaatatcataggcatgcttcttgtcctcttgtagcttatagtctagggaaggagccagaacacacacacacccaattatttaattataactatgaatgaaacaacaacaaaaaagtgtgcttttttttttttttttcacccaggctggagtacagtggcaggatcttggctcactgcaagctccacctcccgggttcacgccattcttctgcctcagcctcctgagtagctgggactacaggcgcccgccaccacgcctggctaatatttttgtatttttagtagagacggtgtttcaccatgttagccaggatggtctcgatctactgacctcgtgatcagcccgcctcggcctcccaaagtgctgggattacaggcatgagccactgcgcctggccaaaacatagtgtgctttgaagtggctaataggatattgattatgctccaagcaaacaacatttaagcagaaacctgaaggaggagaaggacttctctagaggaagaatggagatcatgctgttctgggttatagcagatgcaaaggtcctgaggctcacaccaaatgaggacaaggggaagtggcagtagacatatctgatgaagtggacagaggtcagattctgcagggtcttggtggcttgtgaagaattttgaaagggctggatgcagtgacatacctataaacagcactttgggaggccaaggtgagaggatcacctgaggccaggaattcaagaccagcctgggcaacattgcaagactccgtctccacaaaaaataatgataaaaaattagccaggtgtagtagcatgggcttgtagtcctagctactcaggaggctgaggtgggaggatcgcttgagcctgggaggttgaggctgcagtgagctgtgctcatgccactgcactcaagcctgggtgacagagtgagaccctgtcttttgtttttttttctttttttttttttatggagtctcactctgtcgcccagactggagtgcaggggcgcgatctcagctcactgcaacctccacctcccaggttcaaatgattcttctgcctcagcctgccgagtagctaggattacaggtgcccatcaccacacccagctaatttttgtatttttagtagagatggggtttcaccatgttggccaagctgttcttgaactcgtgatcttgtgatcctcccacctcagcctctcaaagtgctgggattacaggtgtgagccaccgtgcccggccaacctttcttttaaaaaagaatttcagagtcctttcccctccccccaagaataatggggaaccatgaaaggtttaaaactgttaaattatgtattatttattacattaaaaatatgtgtaacttattggaggcaatgaagtataacaagcaaatgaatatatctgatgtatttccaaatataataaagataatatcatcaatgtcgctggttctcctatatgtttcttctccattctatctccttgtatcctccttagacagccacttggaattttgtgtttattatttccctacttaaaaaaatattttcccatggtatgtacccctaaacaatatctgcctagtattgcttgtgtttggagctttgtaaaaatgatatcatactacatatgactatagatgtatgtcttttatatgtatgacttctctaatttgctctgtttcactcaatatcatgcctcttagagtgtaagctgtgcagggacataatattgagtgagaagtcacacatataaaagacatacatccacaatcatatgcatgattgcctctaagaggcatgatattgagtgaaaccgagcaaattagaaaattgtgtgttgtagtaaacacgtccttcatgttgtagtgtgtagttgtggtttgttcattttcccccttgtgtattagggtaatagatggattttaagtcgggcacgggaggacatgaaatcagacttgaattttcatcttattttgctgaggttgaagtttggtttggttgctgttgttttcttcctaggggttctcttcaaatgtaaggaagatgtgatacccgataataagcagatccagcaatgccaagagggaaccgcagtgaaacctgcatatgcaagtattttttaaggttcctagtttttgaggttttcttagaagccatttaggtagaatgttgtttttgcagttctaacaaaggcaaaagtaatagtggccaaaaccagacagcagtttatttttctcctctgtaacctgctgagtgtaagctgtgcagagctcataccatggctccattatgctctgccagcatcaacacaagactcccactttgtggcccaaggtggcagctccagctcctgccctcacatctgcattccagcttgtgggaaggggagaagaggaagtgaaaagtacggtccttctctttaagcgtatgacccagcaccacttctgcttgcacctgattgggtagaaattagtcacatggtcccacctagctgcaagggaagctgggaagagagaatgtttgcctatctaaaacttgaggattctcttaataaaagaacgggagaatatattggagtcttcctgccagtgaaggtgttgatgctgcaactgagtaatgttggtgtgggggtgttacacagccagccaggccaaaaggaatttggacatcctgactgtctaatgaagtcattacaatgagtaaagactccatgacctctttagaaatcaatgtcactattctaaatatgagcttgtaaattggctatgggcttcccacatgccttggaccactgtttttcttttttaattgtggtgaggtacacataacataaaattcaccactttaactattttaaagtgtgcaattcagtggcacttagaccattcacaatgttatgcaatcatcacctcaatctagttctagaaatttttttttttttttgagatggagtcttgctctgttgcccaggctggagtgcagtggggtgatcttggctcactgcaacctccgcctcctgggttcaagcaattcttcctgcctcagcctcccaaatagctgggactacaggcacccaccaccatgcctggctaatttttgtgtttttagtagagacggggttttgccatgttggccagactggtctcaaactcctgaccttgagtgatccacctgcctcagcctcccaatgttctgggattacaggtgtgagcaccgtgctcagccaagttctggaatatttttatcactaagcagtcactccccattctcccctcccactagcccatggcaaacactaatcagctttctgtctctgtggatttgtctattcttgacatttcacagaaatggaatcatgcaatgtttgctcctttgtgtctggcttctttcacttagcatgatattttcaaggttctttcatgctgtagtacatatcagagaactccattcctttttatggctgaataatattccacatggaccactgttagttcatacatttcctcttcttttaatatcactggttgggaacaggccccccaaaatctggccataaactggccccaaaactggccataaacaaaatctctgcagcactgtgacatgttcatgatggccataatgcccacactggaaggttgtgggtttaccggaatgagggcaaggaacacctgcccagcccagggcggaaaaatcgcttaaaggcgttcttaaaccacaaacaatagcatgagccatctgtgccttaaggacatgctcctgctgcagataactagccagacccatccctttatttcggcccatcccttcgtttcccataagggatacttttagttaatctaatatctatagaaacaatgcttatcactggcttgctgttaataaatacgtgggtaaacctcgttcaaggctctcagctctgaaggctgtgagacccctgatttcccacttcacacctctatattcctgtgtgtgtgtctataatttctctagtgccgctggcttagggtgtccccgattgagctggtttcagcaatcactaagtagttttgctatttgtttatgtttgctttttttattcatggaaggaaaaggtgatgtgattctaattctgatcaagtaatgagttttagtttccctgagaattctagagactcaggaattcagagccacctcatatgatgggctttatgggctaatttgtagattacatgcttgggggaatacatcgattcatgctcacaaatgctctttttttttttttctgggacgcaggtctccttttgtgcacaaataaataacatcttcagcgttctggacaaagtgtgtgaaaataaaacgaccgtagtttctctgaaggtaacgattgggtcttttaaattgtgttttgagtttcaaacatcttgggcacactttgggtgcagaaagatgtctttatggctgggcgtggtggctcacacccataatcccagcactttgggagattgagtcagatgaatcacttgaggtcaggagttcaagaccagcctagccaacatgatgaaaccctgtctctactacaaatacagaacttagccgggcatggtggcaggtgcccatagtaccagctactcaggaggctgaagcaggacgattgcttgaacccgggaggtggaggttgtggtgagccaagatagcaccactgcacttcagccttggcaacagactgagactccatctcaaaaaaaaaaaaaagaaagaaagaaatatctctttataatgaatggattgtgaattaatatttaattttttatagctgtaagatttgaaaaattagcatacagtaaaattacctttttacttgtatagtttgatgagttttctcacctgaatagacttgttgaactaccactataattaggatgcagaacagtttaattatctccaaacattcccttgggcttctcctttatagtcagatactccctccaccactaaactctataaatccctgatctggtctctgtcaccagagttttgtctttggaagagtgttatataaatgaaaccacatagtatgtggtcttttgagactggcttctttgactcagcatagtgcatttgagatgcctggatagtgtgtatataaacaatgccatttcctcctcctcctccttcttccttctttcttttccttcctttttactgttaatgagattcagcacattctcattgctgtatataaccatcaccattatccatctcaagaactttctcatctttctcatcttttcagggggacagaattggttggtggttttttttgtttgtttgttttgttttgtttgtttgtttgttttgagatgaagtcttgctctgttgcccaggctagagtgcaatggtgcgatcttggctcaccgcaacctccacctcccaggttcaagcgattctcctgcctcagcctcccgagtagttgggattacaggcatgcgccaccatgcccggctaattttgtatttttagtagagacgaggtttctccatgttgatcaggctggtctcaaactcccgacctcaggcgatccacctgcctcggcctcccaaagtgctgggattagaggtgtgagccaccaagtctagccaaaagctagtttttcttaagctttaagttgaactcattgatattgtcattttctttataaatctggttatttttgtatgaaaataagaataacacttttacttataattgtattaattttaaattaatacatttatttttattcataaagtatacattcatccctagggttttcagattaaattttgataaatgattaatcctatttacaaacttagttcaatttcctcgaatgttttatactatgtttataaatattccaattcccccctcccgctccacccaaatttcaagtacctggtgaagaggatttacaaatctaataggcaaagtcacttgggtcctgagcgactcataaatccaatcgatcgaatctataaatataataattcagattcttttagacattcaatatggtttataaatagccacgttctcttaaattgttcatattaaaataacaagtctaattgctttttgcaataaaattatgtggtttattggttagcttctctaatgtgtcaaactgttccaactctttttttttttttttttttgagatggagtcttgctctgttgcccaggctgcagtgcaatggcgcaatattgactcactgcaagctccgcctcccgggttcatgccattctcctgcctcagcctcccaagtagctgggactacaggcgcccaccaccaagcgtgggtaatattttgtatttttaatagagacggggtttcaccatgttggccaggctggtctcgaactcctgacctcaggtgatccacccacctcagcctcccaaagtgctgggattacaggcataagccaccacacccagccccaactctttaaataggagatgtttctagattatgctaaagatgtcaaaaacttctaaatttaacacaaatcctactaaggatgtttagtttgcctaaaattttctaactttcctgaggatataaaataacttccctagctaagaataaatttaacatatcagaggggcgggatttgaagagattttgccagttgtcgaactgagtactatgtttcctggagatggtcctagttgagatgtttctgctatgtcagtggggaggggagtcccacacccatgccttttggggattacagagctcagggcttcctgtttctcttggacaaatatctctcaaatgtcccgcttaccccgtgtttattgaaatcctttttttccttttatcatctaatttggatagatagaaacttgtattgctgctcaaatttcagtttaatttcctctaccatctgactggatttaattcatttaatgcattttcctgcatttattaggttctggattccttttagttttttttttttttttttttgcttgggtcagagtcacatgtgatagtcaatttattgataataatcaataataaggggaatcatatgaatattactattactattgttgttattgtttttcttaccttaatcctattcctcaaacacatccagtgttaagaggtagataagtatcttcccctatctttttaccttgtaagcatgtacacacatacacacatatacatacatacacatacaaataaacacacacacatatacacacatgcgcacacacatacacatacatacaaatacatacacgtatacacacgtgtacacacacatatacacctcccccacatgcacacacatgcacacacagtatgtacacacatacacacatatacatatgcatatacacatataacatacatacacatgcacacatacacatacaaatgcatacacacacaccccacacacatttacacacatacacacaccccacacacatttacacacatacaccccacacacatttacacacatacacacatgtatacacacatctatgcatgtacccatacacacatacagacatacacagacatctacacacagatacacacatacacatccacacacatatacacactcctgacacacatacacacatatatacatacaggcatatacaaatgtacacacatacacaaacacacatatatacacacacgtatacatacatatacacaaacacacatacatacataggcatacatagacatacacagagatatacacacatgcacacgcatgtacacaacccaacacatacacacatatacacacacccacatatataagcacacacacacacatgcacacacagtgcagtcattttattgagcacttactatgagaggtttaggacagtgattaatgattcagcctctgctgccagactgccaaggttcaaatcgtggttcttccacctgctagatatgagtccttgtttctcctttcaaaaatcaaaataatcataaatagcctctacttcatagatatcttctacaaattaaacaagttaatatataaaagacatttagagcaatacctggctcgtaataagtgtgtgctatttttatttctatatgccagaacataaataccataatataaaattttaaattaaaccaattgtttctaaaccaaatgcaatactatatacatgatactctgtaatttgctttagtgaacagtggctcagagacccttttgcttgttaatgcctataggtatactgcaatattcattttaacagctgtatggctgttatttgatttcatcttcatttattgacccagtctgtagggcatttaggctttccacaaactatcctgagatgaacatcactggacaagatccttgcacaacttttaagtatttctgaaaagattaattccaggaaggggaattgctgtgtcaaagggtatatgcaatttacatggctatgggtacaaacttactgcattgcataaaggttacatcaatttgtctttcttgcttgctttcttgctttcttttgacaagatctcactctgtcacccaagctggagtgcagtggagtgatcatagctcactgcagccttgaactccagggctcaagagatcctcccacttcagcctcctgagtcgctgggactagcgtcatgcaccaccgtgcctgctcttttttaatttgtttgtacagatggggtcttgttatgttgtccaggctggtcttgaattcctgaacttcaatttgtatttctttttttttcttttttcagacagcctctctcactgtcgcccaggctggagtgcagtggtgcgatctcagctcactgcaagctctgcctcctgggttcaagtgattctcctgcctcagcctcccaagtagctaggattactggcacgtgccaccatgcccggctaaatttttttgtatttttagtagagacagggtttcactatgtttgccaggctggtctcaaactgctgacctcatgatccacccacctcagcctcccaaagtgctgggcttacaagtgtgagccactgcacccggcctgaatttgtatttctgatggggcttcttgaatcagaaaaaggagcccgagtggatgccccttttaattctcctttggatggactcccagcctattcttaatcagaaaagggacagctgttatttcattaatgagagagagagagagaatgaacaaacacatctttccttgcagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttaggtaggagacaccctttgtggcaaggttacacctaggggatgattttgaaagttgactttggcaatgggatattccctgggtttcccacccattctttccccaactgtttaaaaactttgaattcacagcaaagcaagtctaatcatattaacaacattttccattcactgagtgcttggcaaaggccaggcactgtgctaagaccatatcattaatttattctacaaatatttgctgattagctgctatgtgctgggctaaggtatgacagtcataggctgtgctcaagtacttcctgtttgccctgctgggcccatggtagaattgtacttcctggctactgtgtggttaggtgggatttggggagtagctcaggccaataaatatgggaatagagtagttgcaggtatgagactttccagaactttccctctgcccatatgaataacagtgcttcagatcacagctgctccttctgcctgggtcccagaataaagacaatatagaacatggcctcaagtcaatttacaatagacccaaagcattaatgagatgtaaacacttgttattttttaatccactaagacttagggttgtttgttactgctgcaagactgatcctttcctgactgatacatacttgatagataactacttgggaatagtggttgctgtagatcttttacattagcaccccactcctggtagtagttccagtatcattcacataaacctacgaagttcctacctaatggatgcccagacggccaagaggtggaaataaagtatttggtggactccaaccagtagtgaacaaaattagcctcatgaatctcatattttagtgagttgagtcagataataaacaaacagacatctggtataccaaatagaggtagcactattgagaaaaagtacagcaggctagggaggttagagagggttgggattacagggagagttgctattttatatagcaagatcagagtaagtctcattggggcagggatgtcagggaagagagccacgtaaatatctgcagaaagagcaagtgcaggaatacctggagaattcaaggaacaatgaggtgcacagtgtggctgaagtggcattgaagatggtgagagcagtaggagaaaggaagggagatggaaatgtagataaatgtagggagttaaggttttttttttcttgagacaggttctcactctgtcacctaggctggagtgcagtggtgtgatcatagctcactacagctttgcactcccaggctcaagtgatcctcctgcctcagcctcctgagtagctgggaactataggtgtgcaccaccatgcttgtctagtttttaaaatttttggtagaaatgaggtcttgctatgttgcccacgctggtcttgaacttctgagctcaagtgatcctcctgctcggcctcccaaagtactaggattacaggcctgaaccactgtactcagccaagattttatttgaagatgaaaggacattggaaaatttgggaacaggtatggtattatctggcttatattttacaaggatacttcttgttccattatctagtttattttcatgaagggccagtgggttaggtcctgcaatgcttgtcatgatagagatgagaaattggaggcacagagaggttaagtcaatgcgcaaatttaggcagctagtgcgtggcagagctggacctcccagttaccaccatctgactacagaacctgagctcttgtgtaccatgctaggcttgccccaatcccttactatttcttttggttttagaaaacttatataaggccgggggcagtggctcacacctgtaatcctagcactttgggaggccgaggcaggtggatcacaaggtcaggagatcgagaccatcctggctaacacagtgaaaccccatctctactaaaaatacaaaaaattagctgggtgtggtggtaggcacctgcaatcccagctacttggaaggctgaggcaggagaatggcgtgaacccgggaggcagagcttgcagtgagccgagatcgtgccactgcacaccagcctaagtgacagagtgagactccgtctcaaaaaaaaaaaaaaaaaaaaaaaaaacttagagagaaaatcatgactgttgccttccatcactgttgactttgaccccatctttccctgatgcaccccctaggagatgagagttcacttctaaggctccagctgggttactcatttatttggtgctatggtccccctatcattcatcatgggcctcaagatctttcctatgatgaattgaactttctattcttttcctttgctcgccatgatggaggtgtacctttttttggacagaaaccaaattcaggactgactttctgggtgacctcatacgaactctccctttctctttttagacattgagagcaaagttatcaacaaagaatgcagtgaagagaatgtgacgttggacttggtagccaagggggataagatgaagatcgggtgttccacaattgaggaatctgaatccacaggtacaggtcctctcctgagaatgcaggttatggtgtattccatcaataagtatttatcgatccctttctaggtgccaagaccagtgccagatagttgagaaccaatgagggtagaaatggtccatgctctcagagagttttccatgtgctagggaagtcaaacattaaataaccttataatactggagtactgagaccttcactggcctatatgatatgtgctggtcacattctgctgttgagcagttgaaatttgtataagccaggttgagaggtactgtaaacctaaaataaacactgtatttcgaagctttgttgcacaaaaagaaggattaaaacgtctcactcatcttttttatatttaaaataatttaaaaataaaaaatatttaaatttttaaaatatgtaatatttaaatttttaaaatatgcaatatttaaaatatatctttaaattttaaaatatcacatttatatgttgaaatgataatatttggcttatactgagttaatatattattaaaattaattttatctttttttacttttaaaaaatgtgtactagaaaatttaaaattacatatgtggttcatactgtatttctgttggacagtgctaatctgtgtcagggatggcaaactttttctgtagagggctcgttagtaactattttaagcattgcaattaatacagcctctatcacaatgatttaactaccattctagtgcaaaagcatccatagacaatatgaatatgaatgtgcctgggcatgtttcaataaaactttatttaaaaaagtaggtgacaaccagattggcccataggccacagttttccagcccctgatctgatctatgcatacgattaatgctatgattaatactttaatgtaaaagcacagtgtgcaatatggaagagctatttaagcgaagtcctgaggaataggtagagaaagcaggagagagtgtgttacaggaagtataagctatggctctgtgttgaaaaaaagcttggtatggtcatggaactaaaagtagagtgggctggagcatcaggaatgtgggggagagagggaaaagaattgagggtcgctgggcgtggtggctcacacctgtaatcccaacactttgggaggtggaggtgggtggatcacctgaggttgggagttcgagaccagcctgaccaatatggtgaaatctcatctctactaaaaatataaagaatgagcctggtgtggtggcgggtgcctgtaatcccagctactcaggaggctgaggtaggagaattgcttgaacctgggaggtggaggctgcagtgagctgagatcgcgccactgcactccagcctgggtgacagaatgagactccatctcaaaaaaaaaaaaaaaaagaattgagggtgttgcatcccagtttattacatttggactttctctgttgggcacagaaagccttggaaagttctgtatacagcaggatgatctgattatgtcttccagatagatgtctttttagaaataaatcctctggctgtgatatgggcaatccattggagaggtgaggctaggggaaggcaaggacatttgtgaggaagccagtggtctgggagagagatgtgaggcttggtctaaggctaattagaagggagaagtggggagaagacaggttcaaggcacattaaggaggaggaatctgttttgcggggagaagaattcaaggatgactctccaggttccagatcaggtaatatcagttattgaagtaggagatgcagataaaagaagatgagagagccaggcatggtggctcacgcctgtaatcccagcactttgggaggccaaggcgggcagatcacctgaggtccagagttcaagaccagcctggccaacatggtgaaaccccgtctccactaaaaatacaaaaaattagctgggtgtggtctcgggtgcctgtaatcccagctactcgggaggctgaggcaggagaatcgcttgaacccggaaggcagacgttgcagtgagccgagaacctgccattgcactccagcatgggcaacagagcaagactctgtctcaaaaaaaaaagaagatgggagaggaattgctcaatttatgatgtctggggggacatccaaggggcagatgaagcctgggggttggtactgtctggttgggacaggaagcggcataggacgtatccctggagaccgtccatatttaaaggggacactccccaaagagactgaaacagaataaccatagatgtgggagaacttatttcccactgagttgcattgtcccttaaaaacacaagttcaaatttatttttaaatgtagccaagacttctccaggtaagagcactgggaggtctgttttgttttgttttctttttttgtcacccaggctggagtgcagtggcgggatcttggctcattgcaacctccgcctcccaggttcaagcgattgtcgtacctcggcctcccgagtagctgggactacaggcacctgccaccacgcctggctagtttttttattgttagtatagacaggatttcaccatattggccaggttggcctggaactcctgacctcaagtgatccacttgccttggcctcccaaagtgctgggattacaggcgtgagccactctgcccagctgtggaagtttttattttgttttgttttgaaatggagtcttgctctgtcactaggctggagtgcagtggtgcgatctcggctcactgcaatctccgcctcccgggttcaagcgattcccctgcctcagactcccaagtagctggagctacaggtgcgcatcaccacgcccggctaattttttgtattttagtagaaacggggtttcaccatgttggtcaggatggtctcgatctcctgacctcgtgatccacccgccttggtctcccaaagtgctggattataggcgtgagccaccatgcccggccagaggttttttttttttaatggttctagaagcccgctggttattttaatctcagagcagcacggtgaggtgcatgactctctctctctctctctctctccccctccctccctctgtgtgtgtgtgtgtgtgtgtgtgtgtgtgtgtgtgtgttgggtcttctataataacaattgagcaaacgattccttcctttttttcatttggggaaacctgcagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcaggtttgtgaagaggtctctactgagattcttgtctacctgttgggaactcctcgtctctcgattgccttaactctcattttttacgggaagctattgaggccggtaagcttccacaatttccagcaattcaagccaattaacagaagctaccgctagaggaatgaggtctcccactgtcaccaaacagaactaggtccatttgcccatgtgcaacagaaagccaaacaccgaagcaccgggtttttgtagagagagaagtttattgcaaggctgccaagcaaggagacaagagtctggctcaaatctgtcttcccaagctgggaggctggggcaggttttatagtcggtgggtaatgaactgcaatctgattgcatcttacaatgaagtgatgcagggaggtgtgatctgattggatccggccatggggtgttgccaggtcttgatctgattggatcctggatcctgctatgtggtggttgcttctttttttttttttagtctcactctgtcacccaggctggagtgcagtggcacaatttcaagtcattgcaagctccacctcccaggttcacgccagtctcctgcctcagcctcccgagtagctgggattacaggcgcccgccaccatgaccggctaattttttgtatttttagtgcagacggggtttcaccatgttagccaggatggtcttgatctcctgacctcgtgatccgcccgctttggcctcccaaagtgctgggattacaggcatgaaccaccatgcccgcttttttttttttttttttttttttgagatggagtttcactcttgttgcccaggctggagttcaatggtgcaaccttggctcactgcaaccctcacctcctcgggtaaagccattctcccgagtagctgggattacgggtgcccaccacatgcccagctaacttttttgtatttagtagagacggagtttcaccgtgttgctcaggttggtctggaactcctgagcttaggtgatccacccgcctcagcctcctgaagtgctgggattacaggcatgagccaccgtgcccacccttctaggatacattcttaaagcatgttgttcttaaactgttactaaaaatatttctctgcttacttggtttttatgattttttctcccactgcactatgatctctttttgggggaagaactgttttctcatgtctcctgtaaacagcacagatcaaggcatgtaataggtgttcaataaaaacacgttgaatgaggctgggtgtggtggctcttgcctgtaatcccagcactttgggaggtctatgcaggaggatcacttgaggtcaggagttcgagaccagcctggccaatatggagaaaccccatctttactaaaaatacaaaaattagctggatatggtgacacacacctgtaatcccagaactttgggaggcccgaggcaggtgaatcacttgacatcaggagttcaatactggtctggccaacatggtaaaaccccgtctctactaaaagtacaaaaattagctaggcatggtggcgggcacctgtaatcccagctacttgggaggctgaggcagaagaatcgcttgaaccccggaggcagaggttgcagcgagccgagactgcaccactgcactccagcctgggcaacagagtgagactctgtcacacacacacacacaaaccacacattcaatgaataagtgaataatgagtgactatgcagaaggctttattatggatttgatgaaaggaggagttttcttctagcaacagcaatgtgagctgccctatcagattggccctcactgcataatgaaataccagcatttttccccattccctcagaacataccctgtgtattcttgttcccagtgactcttgaggatggtcacatttaatccatttgatggggattcccagaagacctttgtttttttgtttttttgttttttttagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacggtcagtactgatgatttgttccctgaggcagagtatctgcctccaaatccaatgggaaaatattgattaaacatctgttgtgtgtctcccatggggttgggtgttgtgggatggagtcacggggacagaaggggtaggtgatatgcctttgcccctgcagaatttacagtctggttgggaggccatgaaactcaaatatacaatgagaaataatgaccctaagtagggccaggcactggagcaatcacagatcttacttaatgagcacatacagtgtgctgggctctttaagttaagtggttttagacccatttcacagaatgggtaaagtggcccgtctagtcctgaagctagaaattggagcaggtggaattcaaatctggggaagtctctttccactaacacatgcaaatgggtcaagaagaaatgctgtaagaattcagaggtgttggccgggtgtggtggctcatgcctgtcatccgagcactttgggaggctgaggcgggcggatcatgaggtcaagagatcgagaccatcctggccaacatggtgaaacccccgtctctactaagaatataaaaattagctgggcatggtggtgcatgcctgttgtcccagctacttgggaggctgaggcaggagaatcgcttgaacctgggaggcagaggttgcactgagctgagatggcaccactgcattccagcctggcaacagagtgagactctgtctcacacacacacacacacacacacacacacacacacacacacacacaaacaaaaagaattctgaggtgtttccaagagagccgatgatagatcatgaggaaacaatatgaaataagccttggtaaatgagtagatttggaagagaggaaggacatcctcattagtgttgtagaaagtatcctttcacctggctcggtggctcacgcctgtaatgccagcacttcgggaggccgaggtgggcagatcacaaggtcaggagatcgagaccatcctggctaacacggtgaaaccccatctctactaaaaatacaaaaaattagccgggcgtggtggcgggcacctgcagtccaagctactcgggaggctgaggcgggagaatggcgtgaacccgggaggcagggcttgcagtgagctgagatcatgccactgtactccagcctgggtgacagaaccagactccgtctcaaaaagaaagaaagtatcctttcctatcatggtagatccaaggtttaattccctaccagagaggccataagtaagtgccatttcgaggaccctgtggcttaggatttaagagaactggatccagaacaaaactgacttagtttcaagtcttgtctctaccactttctagctgtgttttcttggaaaagtcacttaacttctctgcactgagcccagctctctcatctcaaaaatgagaacaacaataacaaaaaaatactgataactagtatttatatagtatgcttctggcacagttgtacttgaaatgttttcatttaatcctaaaacaactctataaggcaattgccattaatattctcttttcaacagatgaggaaactgagggcacagagcagttaagtgtcttgtccaaaatcacacaactagaaattggccagtttttttctttctttttctttttcttttttctagactgagtttcactcttgttgcccaggctggagtgcagaggtgtgatctcagctcactgcaacctctgcctcccaggttcaaccaattctcctgcctcagcctcccatgtagctgggattacaggtgcccgccaccatgcctggctaatattttttgtttgtttgtttagtagagataggatttcgccatgttggccaggctggtttcaagcttctgagctcaggtgatccacccgccccagcctcccataagtgctgggattacaggcatgagccactgcgcccagccaatggtcagttttcttaaccactttgtgacaatatcatagagaggtgctcataagatggtgcctggcttatctttaacccacagaaaccactcagagacatttaaaattaattttaaaattaattatgaataaatggcatagaagaaggacttagcttgtcacgttccactcctgaagttgaagcattcctgaatgtctgcattatcagttgggattcagtacaggaagcaaaaaccaccccaggtatttcaagcagaaaggcatttaacacagggaattgggtgctcacaaaaatctctgggaggggatggaggagttgaagtcagggggctgtcacttcaattttggcttcaaggtcatcccccaatgcagctgtaactcagaggtcagaaattgctgctgtcattttgccaccccactccaccatgaaattggggactggacagttgaaatgtggaattaggctcactcctgtctgccgaaagctgatatttgcctcccttctgcattccaaaaccttcacagatgtatctcactggagaacttaaattacatccaggaccttagttccaaaggattctgggagatgtagtttgtggacatcaagccccagtaatacatggagtaacgcataggacaggactgggaataggtgctggtggatgccagtggattgcaaaggataatgaaggacagtatctagttcactctgagtgttagagggagaaaattcccccaagctaattttgcccgagccagggttttagataactcttcttcccgcctggggggattttgatcccattctcaggccaactctgaaattccttcctgacagatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaaggtctacatcgctcgggctgtgtccccaccaagccccatcttctccccacctgcctcagctcattcctagccaactccctctatccctgttcctacctcagggcctttgcatatgctgtgccctctgcctgtaacactcacttcccagcttcttacctgcttgactccttgtgacagctctcagtttaaacttatgtccctgatcgtgttatgaattatagtggttcctcctattacttgtttttgtttgtttgtttgtttgtttttgatactgagtttcgctcttgttgcccaggctggagtgcaatggcacgatcttggctcactgcaacccctgcctcttggttcaagcaattctcctgcctcagcctcctgagaagctgggaatacaggcatgagacactatgcccggctaatttttttgtatttttagtagagacggggtttcaccattttggccaggctagtcctgaactcctgacctcaggtgatccacccgccttggtctcccaaagtgctgggattataggcttcagccatcacgcacggcccctcctgttactttctaaaccagaggttctctccctgggtgctttttgtccccaggggagacttggcaatgtctggggacatttttccttgtcacaactggagcagcgtgctactgctctctggtgggtaaaggttagggatactgctaagtatcttgtcgtgcccaaggcagccctccacggcagagaatgactctgcaataatgttacagatgtcgataatgctacagtttagaatctctacttccctttatttttcttttctttttttaaatttttaatttttttagtttttttgagacagggtcttgctatgtcacccaggctagagtgcagtggccgaatcacagctccttatagcctaccaggctcaagcgatcctcccacgtttgcctcccaagtacctgggaccacaggcctgtgccaccatgtctggctaatttttgtatttttgtatagagaggggggtttcatcatgttgcccagtctggtctcaaactcctgggcttgagcgatctgcctgcctcagccttccaaagtgctgggattacaagcatgagccaccacacccagccagtaaaactttatttacaaggcaggcagccagcctatggggtctagtttgctgaacccgcctgttttcaaccattccctaaagtagggtgatcgacaatcagttttcctaaaactcttcctgttttagaactgaaagtcatgcgtcttgggaaatcttaggtccagacaaaccaggaccatgggtctccttaccaagaagtgctcctccctgtggtcaagaaccactgcacctctctataaatgtttgtgagatgaatgagtgagctaggtttggggaatttccagccgaggagtctctctcttcctttcttcctttcgatttctctctggggtggaggattctgatgcgcatgcttctcccctccagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcggtgagtgacatcctctctcttcctgaagaccctgctgccagggcttatggtgataatgacatgagcaacaagaagagtaacaacagtagcagtagttgtggctaccatttatcgagctcttctattatgtactattggtttcaggaccaccatgtacagcagcatgggttgtgcactgcacaaatccaggatcactactatttgaggtttatgttccaggaagagaacatctggtttacctaacttgattattttccttttcttgcgtgtatgacatggggggtggtgggggtgaaagtgggaaaggaatacttctgcatggtggtgtgcacctgtaatcccagctactcgggaggccgaagcagaagaatcacctgaacccgggaggcggaggctgcagtgagatgagatggcatcattgcactccagcctgggggacaagagcgagacttcatctcagaaaaaagtggggggaatattggggtgctgttattgaacatgacggaatggttgttgtgttgtaaaagcagctaatgtacactagagacataataaaaggagccaatcctttcttcctccctcccactctccctccctccctcctcccttcttcctccctcccctcttccctccctccttccttcctccctccctccctcccttccttccttgccttccttcccttccctccctccctctcttcctcccttcctccctcccttctttccttctttccttcctttcttcgaataaacaattttatgaaatatcttgtctatgctaggctgtgctctgagtgctgagtattcagagatgaacaaacacctaaggcccaaattctcatgaaactcatagtctagtagtggaagacagtttgcagttacacaagcaattaaacaaggtaacttacgatagtgatagctgctgttttaaaaatgcagtgagctctgctagatggataccaggagcagagacaggttgccctatctaaggatagtcaggagtggcttctcagaggaggtgacatttgagctgagatttatttatttatttatttatttgttatttatttatcttgagacagagttttgctcttgtcacccaggctggagtgcggtggcgtgatctcagctcactgcaacctccacctcctgggttcaagcgattctcctatctcagcctcccaagtagctgggattacaggcgtgagaccccacgcccggcctgagctgagatttgaatgataaggtgtaccagtggagagttctgcatagagggaaacaggattacaaagttgtgaattgggaaatgagctcaaccttgggcactaggtaaacatttcaggtacatttgcccaggaagaaggtctaaaagaggaagcgcagtgatctaaaggaaactgaactgcaaccgggaccatcctgagcatcatctgagtctcacctcccagtgttctcctccactagggcatttgttgggacagggttaactgtaaggtcaggactctgagacaagcgctgactcctcctatttctctccacagctgctggctgaatacagagacagggttcatctggagtttcttggggccagtttgcacagttatagtggtaagcaaatactacaacagcctggcgaagtgtgttctgaaggaggagcaaggagacctgcgagatctggaatttccagggacgtgtgcagctgagagggtcacttattcccatcaaaagttctcctttccaggccgggcgtggtggctcacgcctgtaatcccagcactttgggaggctgaggcgggtggatcacctgaggtcaggagttcgagaacagtctggccaacttggcgaaaccccatctctgctaaaaatacaaaaaattagctgggtgtggtggcgagcacttgtaatcccagctacttaggaggctgaggcaggagaatcgcttgaatccaggagacatggaggttgcagtgagccaaattcatgccactgtactccagcctgggcaacagagtgaaactccgtctcaaaaaaaaaaaaataaataaataagttatcggccaggttgcggtggctcatgcctgttatcccagcactttgagaggcccaggatcacttgaggtcaggagttcaagaccagcctgaccaacatggagaaaccccatctctactaaaaatacaaaattagctgggtgtgttggcacatgcctgtaatcccagctactcaggaggctgaggcaggagaggagaattgcttgaaccagggaggcagaggttgcggtgagccgagattgcgccattgcactccagcctaggcaacaagagcaaaactccatctcaaaaaaaaaaaaaaaaagttctcccttccaatccttcattcttgagatttcgaagttacagagtaatttctttgacttgggaattttgtttttccttctgaaaggcaaatacccctgggagggaccataattgtatccgtcttgtgcacaggtccatgagtctctctgaagcagtgtcattgtctgggggtaataatgcctgaggttcgttgcctcatgctaaggaaatcaaggacacagacacacacaaggagtgagtttaagagcagaggtttaataggcaaaagaaagagaaaggagactagctctctgtgtcttgcaagagagagggcctcctgagtgggacttctggcccgcagcaaagtgcaacagattttagactggcttgagggggcggtgtctgatttacatagggcccaaagattggttggacccagtgtgacatttacgtagagcgcgaggaagctggccacccaccctgatcttttattatgcaaatggggtctttacttggctggcaccatgttgtcttctccttactgtctacatggtttacaaagaaaagggaagacggagctgccattttttttttctttttttttagacggagtctcactctgtcacccacgctggagtgcagtggtgcaatctcggctcactgcaacctctgcctcctgggttcaagcaattattctgcctcagcctcccgaatagctgggattacaggcacgcaccaccacacccggcaattttgtatttttaatagagatgggttttcaccacgttggccaagctggtctcaaactcctgacctcacgtagtttgcctgcctcggcctccccaagtgctgggattacaggcatatgccactatgaccagctaatttttgtacttttagtagagatggggtttcaccacgttgaccaggctcctaacctcagttaatccacctgcctcagcctcccaaagtgctgggatttcaagcgtgagtctctgcgcccagccagagctgccattttgaacatgcctattccccaggtaaccgctttcctattggcacaactgccagcattcacccatgcaagcttctagcttgcctttctatgtctatagctcgattctaccggctgctctccattagaaaagaaaatgatttgggagctgcttttcattaaaaggaaaaccttaccgaggacttccttaccctcactatctgcctaaataaatcttttttaaatcctatgtcatctcctaggcacagatgttgaatgaaagaaaaagtaaaaagaaattaggaggaattgtgggggaaggagtgagatgacagagggaaatggtggatcgaggcaaagggaggccagggaatgttaaacacccatctctttgcctcccaacctccatccagacttgacagccctgccagatgatgattcttctgactctcactcatggtggctcattcccttatgtcttttgtcatatttttcgaggattaaatttttttttatttttaatttttgtgggcacaaagtaagtgtatatatttatggggtatatgaaatattttcatacaggcacagaatacataataatcacatcagagtcaacgaggtatctgtcccctcaagcatttgtcctttgtgttacacacaatccaattatgttcttctggtttttgttttgttttattgtttggtttatttttatttttattttgagacagagtcttgctctgtcacccaggctgcagtgcaatggcatgatctcagctcattgcagtctctgcctcctgggttcaagcgattctcctgcctcagcctcccgagtagctgggattacaggtgtgcgccaccacgcccagctaattttttgtatttttagtagagacgggatttcgccatgttttccaggctggtctcgaattcatgacctcaggtgacccacccgcctcgacctcccaaagtgctgggattacaggcatgagccactgtgtccagcctctcctggttatttttaaatctacaatgcaattattattaactatagtcaccctgttttgctaacaaatactagatcttattcattctttctatttttttgtacccattaaccatcccctcttccctgttccccacccaccccttcactatccttcccagcttctggtaactgctgttctactctctagctccatgagttcacctgttttaaatgtttagctcccacaaagaactgagaacatgtgaaatgtgtctttctgtgcctagtttcatttgtaatgtttacttgactgatctaagtcttgggaatgcttgaaattatattcctccacagaggttttgtgctgatgtctatcagattttttttaatggggggcatgtattaattttcaggggtcaccgtaataagctactgcatgctgggtggcttagaacaacagagacttgttgtttcacagttctggaggcttgaagcctgaaatcaaggtattggcagggccacgctccccatgacaacacgagggagggtctgttccagacccctctccaacaaattttcccatttgtaagatcaccggccaggtgcagtggctcatgcctgtaatcccagcattttgggaggccgaggcgggtggatcacctgaagtcaggagttcgagaccagcctggccaacatggcaaaaccctgtctctactgaaaaatacaaaaaatgagccaggcgtggtggcaggcaccaatagtcccagcctcgggaggctgaggcacaagaataacttgacccctggagggagaggttgcagtgagccgagataacatcactgcactccagcctgggtgacagagggagactgtctcaaaaaaaagaaaaaaaaaaaggaacactagtcatatttcagtcagattagggtctgccctaatgagttcatcttaacttgattatttctgtaaagattctatttccaaataaggtcttggggcgcctggccccaacagacagcctcttaagctcgttaagaaaataaaaacaaatcttcagaggccataaattagacagcagtaatgaaccagaatgctgtagctgccctaagggtatttcctaaaatcaagaatctaaaaccttggagattgaatggtcatttgtggagttggatgggcaagccctagggtctgaagaaggtgtagagtccaccaaataaaataaagaccccattcttattgaaagggtggactagaaaataaaattctgggccgggcgtggtggtttatgcctgtaatcccagcactttgggaggctgaggcaggcggatcacgaggtcaggagatcgagaccatcctggctaacatggtgaaaccccgtctccactaaaaatacaaaaaatcagccaggcgtggtggtgcacgcctgtagtcccagctactcaggaggctgaggcaggagaatggcgtgaacctgggcggtggagcttgcagtgagccgagatggcgccactgccctccagcctgggtgacagagcaagacttggtctcaaaaaataaaataaaaataaataaataaataaatttaaaaggctatctgttggggttcctccagcatttttggtgttttgtagcgagagggattttcagagtgagattcctaaaactcaaagttgatcctgatgctcttctgtgtgaaactgttctatagcttctccattgcactcagggtgatgtccactccctgagcctgacacctcagatccttcactgcctggccctacccaacttccctagggtccctttctggctttttcctgcctgctcggccctctggctgtaccagccaactttctacttccttgaaatgccaagttctcccctctagacctctctcatggaggtggtggtgatgatgaacaaaccatatgtgtgagatgcttagtacaatgccaggcattgccaagagtgcagtaaatattaggtatgaacaatcatggaaataataattatgatgatgttggccagacatggtggctcatgcctgtaatcccagcactttgggaggccaaggcaggcagatcacttcgggtcaggagtctgagaccagcccggccaacatggtgaaaccccatctctactgaaaatacaaaatttagccaggtgtggtggcccgcgcctgtaatcccagctactcaggaggctgaggcaggagaatcgcttgaacctgggagacagaggttactgtgagccgaggttgcgccattgcactccagcctgggagacaagagcgagactccgtctcaataataatagtaatgcaatgtttatcttacccattcccaaatcttcaaggacattgggctttcttggaagttctactcatctggaaaaaataattcccctggggccgtgattctccactggtgcagttttccctctaaggggaagttggcaaagtgtgaagactttttttttttttttttttgagacagagtttcgctcttgttgcccaggctggagtacaatggcatgatctctgctcattgaaagctctgcctcccaggttcaagcgattctcctgcctcagcctctgcggtagctgggattacaggcatgcagcaccacggccagctaattttgtatttttagtggagatggggtttctccatgttggtcaggctggtctcgaactcctgacctcaggtgatccacccaccttggcctcccaatgtgctgggattacaggcatgagccaccgctcccgaccagaagacatttttggttgttacaactagagaggtgggttctactgccatttagtgcatagaagccagggatgctggttaacatcctaccgtgcacaaggcagcccccttctccccgctgcccccacacaccaagaatgctctgacccaaatgtcagtattgccgtgggtgaacaggccctgcgccaggtgtatgtatatcttgctcaggaatgcttttgagggagggctttagaagataaactcaagataataaactccactcaagttcgcagtctatgtcctaacgtactggatgcactttgggaaaatacacagagaccgccccattgagaacaagcaaaggctgtttattccgagatttctgtagtccagtagtacgagagtcagctaccatcatcactcgcgttggctcagactcaaaggcaggcagagaagtggggaaggtttatagaggaaaaaaagagaaggctacaggtaagtcctgcttggaggctgttgcacggatgggcaagctgtaggtggctaactaggagcggggtatcctgtgtgattggttaggggtacctattggcttctacctgttggtcctaagttggaagtagggacaaaaattaaggaagctgtcaattactaactaagtcctgctgtcttggttcaattgctgcatggatcattctttggctttctggattggttgctataaatcgtgggtcagaattcttcttcttcttcttttttttttttttttttttgagacacagtcttgctctgttgccaggctggagtgcagtggcacaatctcagctcactgcaacctctgcctcccaggttcaagtgattctcatgcctcagcctcccaagtagctgggattacaggtgtgcaccaccacacctgcctaatttaatttttgtattttttttttttttttgagatggagtctcactctgttgccaggctggagtgcagtagcacaatctcagctgtctgcaacctctgcctcccaggttcaggtgattcccctgcctcagcctcctgagtagctgtgattacaggcatccaccaccatgcatggctaattttttttttttttttgtattttagtatagacaggtttcaccatgtttgccaggctggtctcgaattcctgacctcaagagatccgcccgcctcagcctcccaaagtgctgggattacagacgtgagccaccacgcccagcccagagttctctttttataggtgttctggcccttgtctatttgtatatccagtctctccatccttctgcttgactttgcagatcaactcccttctcctgacctggaccttgtggatcctgaggcagaggctttccagtgttaatgccgaagtctcaacgctaaaagacaccaggtaaagccctctttcacctccccccctcttttaatttcctctttcttcttcccagaaaagttctttgagcacttcttgtgtgctgggtcctatgcctgagacagaggtgatgaggtctgtttagcatatcacaccatctagatctggaggcttaaagtccagctcaactatttacgagctgtgtgaccttaggcaagttacgtaacctctcagaagcccatttgcctcacctacagaatggggatattaacattgcttattttaggtgccttacaaagcatttagcacggttactaggaacagtgagtgtttcatatactacaactcttaataaattttctaatttttctctgtgtatacttatatgtgcacatttacaagaaactgaatcatactattttgttttttatggttttttttctctcgagaatgtcctgatgatttctgacttcattagatattattctacaatatggtgtaaatttgtagcacattgtatttaagtcataccatattcatggacacttaatttgcttctatgtgtttttggttttggtttgttctctgtataaacaatactgccttgagcacccttgtaggtaaatccttccacaccatggttatttaattacaacactaaacatgaaactacccaaatccaactgcctgaagagtaggttggactgtaatgcttttagaatgtgcgtcgtaaattgattttcagaaaatttgtttccgacggtgagaatacctatttacttgcaacattgtcaacactggagtttattgtttttgatgtattttctgctgatttaatgcgtgaaatattctatctcattacttttgttatacatattttatattagggatttgggacttcttaaatatttttacaggtcaattgtgtttcctaacttccccactcaactactgttcattttaagaaacttcagcaaccatcatctaggttttattgtcagtaacctaataacattctttgcttcttttttcttcggtatccaatcccttatccattttaaatatgtttgaaaagttagtacaaaagtcaaaaaggaggcctggtgtggtggctcatgcctgtattcccagcagtttgggaggctgaggcaggtggatcacgaggtcaggagatcgagatcatcctggctaacatggtgaaaccctgtctttactaaaaatacaaaaaattagccgggcatggtggtgggcacctgtagtcccagctacttgggaggctgaggcaggagaatagcttgaacccaggaggcggagcttgcagtgagccaagatcacgccactgcactccagcctgggtgacagagtgacactccatctccaaaaaaaaaaaaagacaaaaaggtaaaacaaagttgatacatacacatactcatagcagaaaatgtaagcaataagtttcacatcagatgaaattcaccattttaaccattttaaagcgtgtaactcggtggcttttcgtacattcacagtgttgggcagtgaccgccactatctagtggcaaatccttgttttttttttttttttgagacagagtctctctctcgcccaggctagagggcattggcacggtctcgactcactgcaacctccgcctcccaggttcaagcgattctcctgcctcagcctcctgggtagctgggattacaggcatctgccaccgtgcccggctaatttttctatttttagtagagacgggttttcaccatgttaaccaggctgggctcgaactcctgtcctcaggtgatccaccagccttggcctcccaaagtgctgggattacaagcacccaccaccacacccagctaatttttgtatttttagtagagatgggttttcaccatgttggccaggctggtctcgaacttctgtcctcaggtgacctgcccacctcggcctcccaaagtgctgggattacaggcttgagccaccgcacccagcctgattgcatttaaatgtctataggatttgattttgcaacacctaggcttggagaccccaccctacatttgtccacacctaggtggcaaattggagagtggccacctcagaccattcctggaagtgtggcctgcaaggacaatagccacctcccagagccttacatgctgtacatcttctccccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtgtgtagctgctgccctccccatccccctcctcccatccccctctccccccttccccaccgcatccctccacccaacatccctgtcactggaccatttccctgcatctggatgatgtgtctccttctccaggtacgagaagaatacaagaggtggatcactgggaagacgaagcccagctcccagtcccagacctcaaggatcttgctgtcctccatgccatccgcttccaagacggtgagagactgcatgctccctgcaggtgctggtcgagggaggtgccggcctcttggtgacactcagctctgccacgtgttgggtactgaatgggagctgagggtgcccaccctagttagctcatggatgaagtgtggagttgaagactggggatttatatgtatatattagcagacacacacacattatctatctctctatttaaataaaatttcaagaataagacatatataatttataacagatttacatagatacatttgtatatgaattatgtaacatattaaaaataatacatatttatatgttatgtttataaaatacatttatatgcacttattatatacatataatgtataatattatatacatataaatgtaagatgtaagtttaaatatagataccggctgggcgcggtggctcacacctgtaatcccaacactttgggaggctaaggtgggcagattacctgaggccaggagttcgagaccaacctggccaacatggcaaaacccccatctctattaaaaatacaaaattagccgggcatggtggcaggtgtctgtaatcccagctactcatgaggctgaggcaggagaattgcttgaacccaagaggcggaggttgcagtgagcagagattgtgccattgcactccagcctgggcaaaaagagcgaaactccatctcaaaaaaaaattaaataaatatagatatcttcacatgtatatttatatagagaaaatttttatgtattatggataacatttatatatgtagattttcaggaatattgaaatattggaatgaatatgcaaatggaggcaaagctggttttcccactagaatgtcttatttttttcaacaatgtattccacgcccctaaaatgctgtctagcacacagtaagttcttagtgaatattttctgagtaaataataattcaatagcttagtttcctcactgataaaatggggataatggtaatccttaccttggaaggttatactagatattagatgaaccagtatgcaatggggttggaagagtgcctcggacatagcaggatctcagtgttaagccttgcagaagtccagtgaggtaggtatcactgctctattttcttttttctttctttctttctttctttttttcttttttttttttgagatggagtctcgctctgtaacccaggctggagtgcagtggtgtgatcttggctcattgcaacctctgcctcctgggttcaagcgattttcctgcctcagcctcccaagtagctgggattacaggcgcccgccagcacacccagataaattttgtatttttagtagagacagggtttcatgatgttggccaggttggtctcgaactcctgacctcaggtgatccacctgcctcagcctcccaaagttctgggattacaggtgtgagccaccacgcccagctggtctattttcattatgaggaaaccgaatgtcatagaggttaagtccagtgatttcagaatgagccacaggaatcaccccactggaaaaattgcccatatcatggatgacatattctcttggcaatacatttttaaacataatgcagtttactatagttttaatgaaaaagacagtataggtatagaacattttagaaaacatttgtaagcattgaaaacaaataaaatttcccattatcccaccacatacagatcccagtgagtcatatttttggatgcaagcaccttagatccagtggcttaattaaatagggaaatgattttccttgcaagaagtccagaattaggtgttgcgaatattgctggtgttgctggttctatgcttagtggtgttgtaaaggctctaaactaagaatctgggttttccccagttttccattccaccatcaacatgttgacattttattgtattttcatggttgcaatatggttgccacagctccagacatcatgactatgttcaagtcaagaagaagagggatggacaggaccagaaagcccttctttcatgtctttgtctttaacagtaaatgaaagcccagaaaactctcagatttccctttacctaattggtcagaagtgtatcatgtgaccactcatatgggcaaaaaattttgaaccaacagctgtttggcttcctaaagtccagagtgggcgctgtcaatgctgaggaggttgagaatggcttttgggttttccaactctgcctgccacactagggacaatcgcatttaacattttagtgtttatccttctagtctttgttactgtatttttaatacttctgtccctgtagacatgacccttggaatcacgtttgtattaattctgctgcagactctgaggaaattcttttctctctcacagggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctaggataaagactctttgtgattttaaagaaatggtcagtaaaactgtaatgagagtcccagggaaccaagacggcacatagacagataagctactttggcacaaacacttaaaaatagttgtgttggtaagtagggggatgtttgatgtagcagaattctagcactccctggagggttgaagcacttggtgacaacaacctttggaaagtgctttggtttcctgaggtccttcaggtaaccaagacctccctgttttctagaaactttctaatgacttggctaggatttaggattttctctatcacagttatcgctacctatccttaattttttttttttttttgacagagtctcggtctgttgcccaggccagagtgcagtggcatgatctcggctcattgcaacctctgcctcccgggtgcaagtgattctcctgcctcagcctcccaagtagctggactgcaggcgtgcaccaccacgcctggctaatttttgtatttttagtagagacggagtttcagcatgttggccaggctgatcttgcactcctgacctcagatgatccacccgcctcaccctcccaaagtgctgggattacaggcatgagccactgcgcccggccaccatccttaaattcttgagcttgggagagaagaagatgaaggtttaaatgcaggtattttcacttctatgggcactgtaaaacctcccaatccaaagcgtggtccctggatcatcagcatcacctgagagcttgttagaaaagcaaagaagaatctcagaccccactccagacctcctagatcaggacttgcatgttaacatccccaggggatgaatataaccatgggtgtctgaaaagcactattgtagaacattcttctgtttgccatgctgacagcagagcttgtctttaaagccagagagaaatgtcttcttcttgacttggaccctttgcatcttctcttagaataacttccctgaaaactcaattgatgtcttctgtctctttgagttgcagtgtagtcatcccctctgctaggaagcattctttgaatctcctacagtagaatttggcattatttttgtgtgtgccaaaaagcttcatgctttctcaccctgtattatgatttctctttttgttgggtgtctccaacatagactgtgagcttcgtaagtacagagatttgcattaagtagcgtctcaacaaatatgttgaatgaatgaatgaatgaatgattagaatgattactcttcattttgaagacaggggaactgaagctcagagaggttaagtgactatcccaggatcacacagccacataggtcgttgagctgggttttgagctcttgaccataaagctccttctccagatgccttgttcccctttttctcttcctttcgtgccaggaatacttagtttagggttacagagactagaataatatttactctgagtcacctaagcagttaggattcaattagctcagtcatatcatgcactggacaatttgttaacaatattaaactcagttgatggaggctctgtctttgttattcttggcagcctaacttgggaggtgggacacatgtttgtgaacaagagttcatctatgataaattagtcttcaacgcttggcttatccagagtgctcaatacagaggtgatagttcttagagagatggaagcaagagatggcactgctcctatccatagccaattgtcataggtcaatggcatcaatgggcccaataatggtctccatttagccacatccctttcctgtaactttgtaactctctccttgtctgactctggggttggacttgagatttgctgcagccagtggaaggttaggaaatgtgactggaacgtaagtttcaaaatcgtatgtgtaatccttcttaccagttacacgattacatttgctcaccttgcttccttacccccaccatgtgaacatgcccaagcccgcctgctggagggacatgagaaacacagaatgaagggtaagtcaccgcagttacactggtggaggttgtcctcagccagccaccatgccaacttgctgctttaatcacaggagagagcccagccaacatcagcagacctgctcagccaacccataaacagactgaggagcagcaagaaagtatcatttttcagacactgagtttcaggagttatttgttatgaagcatttatttgtagcaattgctgatggatacaacaaccaaagtatggtcaacattctgcattggactgcaacaatttggaatgtaaaaagaaagaattttgatctcaatttcttctgagatatcaggataataaattctgtactacttgaataaagttttttcctgagagaagatttgcctaaggctttgtctgtctgtacaacggtgttacatgttggtctgaaatatagtcaccttaagaagctctatatttctaaggtaagtggataaaggtgtgacctccatgcaggatttttttcgtactacacacatcaagctatacttggtacattttttttacccttgtggtctcatatgtctccgctagagggagaaaggagacaattaaaaaaaaaatgcggcccggcgcggtggctcacgcctgtaatcccagcactttgggaggctgaggcgggcggatcacgaggtcaggagattgagaacatcctggctcacccggtgaaaccccgactctactaaaaatacaaaaaaattagccgggcgtggtggtgggcgcctgtagtcccagctactagggaggctgaggcaggagaatggcgtgaacccgggaggtggagcttgcagtgagccgagatcgtgccactgcactccagcctgggtgacagagcgagactccatctcaaaaaaaaaaaaaaaaaaaatgcatgagtagaagaaatacgttctgaagttcactggtagagtagggtgactattgttagcaacactgtattgcatatttcaaaatatctagcagagaaaacttgaaatgtttccaacagctagaaatgatcaatgatcaagatggtggacaccccaaataccctgtctttatcattgcaaactctgcatgcaacaaaatatcacatgtaccccataaatatgtacagatattatatatggaaaaccctaagtggctgcaaatcccatgaatataatgtgaaataactttgctatcttataatccaaataattgtgtacagaaaattacagatccattcactcaaaaaatatttattggccgggtgctgtggctcacgcctgtaatcccagcactttgggaggtcggagcaggctgatcatgagaccaggagattgagaccatcctggctaacacgatgaaaccccgtctctactaaaaatacaaaaatcagccgggcgtggtggcgggcgcctgtagtcccagctactcgggaggctgggacaggagaatcgcttgaatccgggaggcggagcttacagtgagccgagatcgcgccactgcactccagcctgggtgatagagtgagactctgtctcagaaaaaaaaatgtattgaccacctctattgtgcttccccctcaaacactgaagtagttaaaaacattgaaacattgaaaagtaattattttagaacctaaaaagtattttaaatttaagtattttatagttcccaaactagaattattaaaattatactttactggttctaatggaagtaaactcatcaataacagtttttaaattggtgtctgaaaagaaaaatcattaaaaaaatattatttggccatacaaaaggagattcctgccatttgcagcaacaagaatgaacctagaggacattacgctaaatgaaataagccaggcacagaaggacaaatactgcatgatctcatatgtgaaatctgagaaaatcaaacacactgaaagaatagaataacggttatgaggaacagggatgaggtgagggagaaatggagagaagtaggtcaaagggcacatagttgcagttatgtaggaaaaataagtttagaaatctaatgtacagcataaagactatagctaatgatattatattgtatttatttcatttatttggatattttctctattttcttagtctagctaaaggtttgtcaattttatcttttcaaaaaaaccaactcttcttttcattgattttttgacttgcttttcgtctgtattttgtttatttatgctctgagtcttattatttacttccttttaccaatttttggcttactgtgttcttattcttctaattcctcggggtgcacagttgggttgtttattagaaacctttcttctttttgaggtagggtgtttattgctatgaactttccttttgctatgtgttaggggtttctgtatgatgtgtttccattttcattggtctcaaggaatttttaaatttcccttttaatttcttcaatgagccatcagttatttaagagcataaggtctaatttccacatagctctaagttttccaaggtttttatagttgttgatttttagttttattccactgtggtccaaaaagatacttgatatgatctctatcttcttaaatatgttaagacttgttctgaccaggcgcagtggctcacgcctgtaatcccagcactttgggaggcccaggtgggtggatcatgaggtcaggagattgagaccatcctggctaacacggtgaaaccccatctctactaaaaatacaaaaaaaaaattagccgtgcatggtggcagacacctatagtcccagctactcgggaggctaaggcagaagaatggcatgaacctgggaggcagaggttgcagtgagctgagattgtgccactgcactccaacctgggcaacagagcgagagtctcaaaaaaaaaaaaaaaaaaaagacattacatggacactaacatgatctatcctagaaaatgttccacgtatagttgagaagaaagtatactcttcactggttggttggaatgtcctgtaaatgtgtgctagacccatttggtctatggaatagtttaaatccatgtgtatttgtttatttcttgactagacaatctgtctattgttgaaagtgggatgtcaaagtcccctataagtactgaattgcagtctatctatcccttagatataataacatttgctttatatatttggatgctttggcgttgggtgtatatatgttgatgatggttatagcctcttgttgaactgctatatcttttttttttttttttgagacagagtcttgctctgtcgcccaggctggagtgcagtggtgctatctgggctcactgcaagctccgtctcctgggttcactgaactgctatatctttaacattagctaatgatcttctttggttctttttgttacgatagtttttgacttatcatcaattttatctggtataagtatgacttataccactcacttttggtttctctttgcatgatatatctttatccatcccttcactttcagtctgtttgtctttaatggtgaggtgagtctcttgtaagaagcatacagtttggtcttttaaaaatttcattcagccactcaatatattttttttctttttctttattttttttttttttgagatggagtctcactctgtcatccaggctggagtgcagtggtacaatctctgctcactgcaacctccacttcctgggctcaaacaattctcctgtctcagcctcctgagtagctgggactaccggcatgcaccaccacacccagctaattttttttttgtatttttagtagagacggggtttcaccatgttagccaggctggtctcaaactcctgacctcaggtgatccacccacctcagcctctcaaagtgctgggattacatgcatgagctactgcacctagccccaaatattttaaaacttttttttttgaagctcttcatggtaatctagggtgtttatgtgtcataaagtatttaatcccagtttgtatcatttctaaattttcagtgctataaacaacactgtaatgaacatctttgagctaaaattttaacactctactgcataagtgactttaaaattagtaataggttataagtgggaagaaatttatatgttccccttagtgtttgattaaagacaaacatttttcactatacaagggctgccaaaactttcccaaactgtaaaaaacaaaccattagaggctgggcatggtggttcatgcctgtaatcctagcactttgggaggctgaggtgggtgaatgacttgagcccaggagttcaagactagcctgggcaacgtggcgaaaccctgtctctaccaaaaatacaaaaattagccagtctcataactggtctctaaataaataaatagataaaaatttaaaataaaataattttaaaagtagccattagaaacatagtaatttggctgggtgtggtggctcacacctgtaatcccagcactttgggaggctgaggcgggtggatcacaaggtcaggagatagagaccatcctggctaacacagtgaaaccccgtctctactaaaaatacaaaaaaattagccaggcgtggtggtgggtacctgtagtcccagctactcaggaggctgaggcaggagaatggtgtgaacctgggaggcgaagcttgcagtgagccgagaccacgccactgcactccagcctgggcgacagagcgagactccatctcataaaaaaaaataaataaatagaccaatatagtaatttgaagtttatttaatttttgctcccagaaaatctttccatcatcagttctaagccatctggttgccttctgatgtgacctttctgttccattttgcctaaagttattaactttttatttgtaatacttggtatgttggatcaatttcagatgagttcattgtctcatttatctctgtaagtttactatccagcagaagattggggtcactgattgggttaataatatttgttaaatgaatatatccaggaaagagagtgtgtctatctactgcacagcaacagaacactattctgatattctgtgtcgtgaagtgatcactcttggttttataaataacagattctgattttcagaatcttcaaaacagatctcttttgtttaattttccagtaacaataaccctgtgctcattctattactaatattactatttataaaatgacaataagtgattgaggtcaggtgttctaaaagcagagcctgagaccaggattgtggtgcccatgatttactgagggagtgcttggaggagaaaagtgagggagtcaggatggggttgggaagttggagggtaaggctatggtctcagctggaagtgattgcagcctgatctccggggagcgctggagcatgagtcatacctcagagttggtctcactttgagtcaagggcccaagccttgtttatgcctgtgtcagtcaattattggctacattgccccgacaatggtagggcagtgcgtcaccttccagatggagcacttcctgttcagctgaaaccagtttcctggagaagaggatgggggctgaaaaggaaattaggaacgggcagcaacagtaccagctactctgctcatgatcatcaaatatgaaaaagaaagctatgagtcccttagatacttgattgaagttcactgtcatgagattttgaactgcattcaaaaaagagtattgtttctaatgatattgcaaacttcttagacattccagtaagcatttcacttactaaaaaaaaaaaaaaaaaatttttttctgccattcacttagacttctttttttaatgtttattttaggttcagggttacatgtgcaggttagttatataggtaagttgcatgtcatggggatttcatgcacagactttttttaatcatccaggtaataagcttactacctgataggtagttttttgatcctctcctctcaccttccaccctcaagaaggacctggtatctgttgtttgttcccttgtttttttgtttttgagatggagtcttgctctgttgcccaggctggagtgcagtggtgtgatctcggctcgtcacaacctctgccttccgggttcaagcaattctcctgcctcagcaggacacccaatcccagggaagttcaaagctaacataagatagaattcagttattcccctagttccttgtaattgaatagaaacattttaccaacttatgttaatattatacaattttaatccctggatattggaactgggtctgactcactaactgaaaactttcacgttttgtgctattcacaatagcacgtttcagagctattgtttttctcatttttcttgccctaaatcacctcagacatctgcatttattactgcaactttgtccttacctataaactaatccctagaccaatggttttcaactgggagcatttttgttcccaggtggcaatgtctggaagcatatatatatacattatatatatatacacattatatatatatatacacattatatatatgcacattatatatatatacacattatatatatatacattatatatatacacaatatatatacattatatatatacattatatatatatgaaataaaaaatatatatttcaaataaaaaatatatatttcaaattaaaaatatattttttcaaataaaaaatatttatatttcaaataaaaatatatatatatatatttttaagacagggtctctctctgtagcccaggctggagtgcagtggcacgatctcggctccctgcagcctccacctcctgggttcaagcaatcctcccacctcagcctcctgaatagctgggattataggcgtgagccactgcacccagctgatttgttttgtatttttagtagatacagggtttcaccatgttggccaggctggaactcgaactcctggtctcaagtgatccgcccacctcagcctcccaaagtgccagcatcacaggtgtgaggcactgcaccccccctctggaggcatttttgattgtcatgactggtggggaagtgtcactggcacctactgaataaggccaagctgcttctaaacaccttacaatacaaagaacaaccccttacaaataagaaattatcagccggcgcagtggctcacacctgtaatcctagcactttgggaagccgaggcaggtggatcacgaggtcaagagatcgagaccatcctggtcaacatggtgaaaccccgtctctactaaaaacacaaaaattagctgggcgtggtggcatgcgcctgtagtcccagctattcagtaggctgaggcaggagaatcgcttgaacccgcgaggcggaggttgcagtgagccaagattgcgccactgtactccagcctgggcaacaaagcgagactccgtcgcaagaaaataaataaataaataaattatccagcccaaaatatcaatagcgcagagtttgagacataataattaggtggaggccgagaatatttaatgtatcatctctgccattcttgccttcacgaattttctaattcagggaggcaggatttacaaacacacgtgacatcatttgtgaaacagcacaccatgtagaagggtaagtcatgttgtacagacctgaataaattgagtttaaaagatggatttatttgaaagcctgaataagaaatcggttttgaaggaagcagaagccagattggctcttaaaaagaatggaaaagaatgagagaggcaggaaggaaagaaagcagccgaccgggagtggtggctcacgcctgtaatcacagcactttgggaggctgaggcgggcggatcacctgagctcaggagttcgagaccagcctggccaacagggagaaacctcatctttactaaaaatacaaaattagctgggtgtggtggcgcatgcctgtaatcccagctactcgggaggctgaggcaggagaatcacttggacccgggaggtggaagttgcagtgagctgagattgtgccattgcattccagcctgggcaacaagagcaaaactccatcaaaaaaaaaaaaaaaaaaaaaaagagagagagagaaagaaaaaaaaaagaacaagaaaaaaagaagaaagcagccttcaagttggaagggaggaaaaatggccaatagaggagtctgaattcaaatctgcaacacctagaatacatggcttatttattctgtctttcttcaactgccatggaccagagagcaatcgcaacatgactaggaattcggcacaagggtttctcagctgcccaggaatattgcattttacgaagcctttattcgtgtacatttgaaattatgcaaaacaaaaagttgcgctgcatgcacacattttgcaaccatgtgaatatcccttcattttcccttttccaaaggaatcccataacttcaaagccagcaggtggagtggatgtacactactctgtttatatctatggaggagacatttgctttaattaagcagaaaagtcctcaaccctttgtctgcaaccctagaagaagacctcacatgattttctttttttttttttttttttgagacagagtaccacggcctcccaggctggagtgcagtggtgcaatcatagctcactatagcctcgaattcctggggctcaagcaatcctaccgcctcagcctcctgtgtagtggggagtacagcaatgcaccactatgcttagctaattttgtaaattttttgtagatatggggtctcactatgttttccagggcgtctcaaactcctggcctcaaacaatcctcctacctcagccccccaaggtgctgagattacaggcatgagccaccgcgcctggtttgaaatttcttcaaataaatgatgataactcttgcctattttaacattgacagtcattagcatttaaaatctttttggagctgttctgtcataacaatcatccacacatttattaatatgctgaaaacatacctaaaaaccagtaactttgtaaaagtaattagacatggtaaaacgaaaaaatgagtccgaatgacccacgttttttgtttccagacatttgtactgggacatgttcaagaggacactaagaaaacaaaatgatctttaacccatgtgtacatgtaggttccaaaagtctcaggcagaccgggctaggtcgctcacacctgtcatcctagcactttgggaggccaaggagggtggattgcctgagacgaggagttcaagaccaacgtggccaacatggtgaaaccctgtctctactaaaaatacacaacatgagctgggcgtggtggcaggcgcctgtaatcccagctactcaggaggctaaggcaggagaatctcttgaacttgggaagcagaggttgcggtgagcagagatcatgtcactgcattccagcctgggcaaccagagcaaaaccctgtctcaaaaaaaaataaataaataaataaaaaagtctcaggcaaagaaaatggggaaaatgtcagtgtcttggacaaaagagcctgcgcagtgacaatacacccctaagctaggatgataatgcatttttgtttttggttttttatttatttatttatttattattattatactttaagttttagggtacatgtgcacaatgtgcaggttagttacatatgtatacatgtgccttgctggtgtgctgcacccactaactcgtcatctagcattaggtatatctcccagtgctatccctccctcctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttcccatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatagctgtgtcaaatggtatttctagttctagatccctgaggaatcgccacactgacttccacgatggttgaactagtttacagtcccaccaacagtgtaaaagtgttcctatttctccacatcctctccagcacctgataatgcatttttgtattgcaaaatgcaacaccctctttaatactgatccatatgaaaattgttgaattatgtgaatgtggagtgttaatgtaagatctttgggagcataaaatacagcagagaggccagaaagggaactatgagctgaatccagatgccagttagtgagtttctggcaaggtggcagtagctgcaagaagaaaatccacttctcccgcccgccatctttaaaatgcatccttccgacacttcattgcacgtgccacactactggactctggatctaagaattctcccaaatgtcttgttctttctatgaacataaaaagccaaaataggtgaatgagcctagacttttcacaggaaagctagaaatagtggcatttgtccaatctatgtgtgaccacaggggcgctgtagacaaacggaaaggagcggtaacttccgggtcattgccatggcacttgccaggtcagttcatctttagccaagcagcagagacgagatgaacctgtggctgcggttgcttggttgactctgcagatgatgatgcagtgcctcctttatgaaagatttctgaggacttccccacttcttcctacttgcggggaagataataaggagaaaaggtgacagagaaattaactaaaacttctaacttgcccagagatgacaagctaggatttctgttaggtccaaagctcaatatctgacattacaacttcccatcctccaaaaaaaactccaccatctaataatggttattttatttgatcttttcacaaacatttacaggggcttcctgtggtgccaggcagccttctaagcgcttaacttatttgacatcatttaatcttcacaatgagaagtgctacccttgctaagaagctctttatcccaaataaagctcatatctttgtaatagctccatggtcttagcattcaggctgccgcaaggggcaaacccagtttcacgagtcacagcacttaggaatctgtggtttctgaccaaaaagagtctcttcctagccctccaaatctaggtaatttcacaaaccggaggtcgtttttatcatacacagccttcagatttttggtcaagtgccagcttcttgtagtcaccttatttaaaactggaatcctcccaccctgtcattcctggctgctctccattgctctattttttctaaagcatttatcactttctaataccataaaattcactttttggggtctgttgtcagttccctcacccaactagaatgttagctctgtgaggtcaaggactactgtcagtgggtccactgatggttctccagcacctaaacagtgcctggcacatagcggacaataaataggtgttaaatgagtgttgttaataaattaaactttttttgttaaatatcccttggatgtttgttgaaggaagaaatgaaaagagagaggaagagaaggagggagtgatagaaagaatgaaacagagagttagaaacgagagaggaggaagggagagaaaaagatagatggtgtaaaagagagtgagaaagaaataaaacgtaaggaaggagagggaaaccaggaatgagggagaggaagagactgagagagagcaagaaaaaagggagaaaaggaaggaaggaaggaggaaaggagggaaggaaggagggagggagggaagaaaggagggaggaaggatggaaggaaggaaggaagaaaggaagggtgggtgggttctggttttggtctcaaaacccagaaacttcagctgcataatacaggaacctaatgcaatttctcttttctttcagatcaaggaaccagaaagcttctagaggcatgagatgtcggattccaataaagcactcagaaggagctgatcttaccgttttggtttgggtagtagagcgagacatctcagtgctttcagtttctacccctttccgcatcccactaaaccactttttatattccattcgaacctggaaatttgagtggagaggtccgtgttacatccagagcttggtttgggagaaaggatcctaaaatgggaggctaaagataaagacaccaagccctactctctagttttccatataatcttggccatgcccatgttgattcattttatttaaactcaaacttctcagttgtaaaaaagatgtgtattaaatatcagacactataggactcaatagatgatgatgatgatggtgatgaaggtgactgttgatgatagtggtggtggtaatgaaagtaattaagatgatgatggtgatgatgaaggtgatggtaatggtgatgatggtgatgaaggtgataatgatgaagatgatgataaaggtaatgaaattgatgatggtgaaggtgatggtaatggtgatgatggtgagggtgatgatgaagatgatgacaatgaaggtgatgatagtgatgatgatggtgaaggtgatgatgatgaagttgatgataatggaacggacgatggtaaaagtagcggtgatgattaaaatgatcatgatgagggtgatgatggtgatgttgatgaaggtgatggtagtgaaggtgatgatgaaggtcatggtgatggtggtgatagtgatgatgaaagtaatgtgaaggtgatgatgaaggtgatggtaatggtgatgatggtgatagtgatgatggtgatggtgatgatggtgatggtgatgatgaagatgatgaaggtgatgatggtgaaggtgatgattataaaggtgatggtgatgacagtgatgatgataaaggtgataatgaaggttatggtaatggtgatgatggtgatggtgatgatagtaaagatgatgaaggtgtgataaaggtaatgaaggtggtgatggtgaaggtgattattataaagatgataatggtgataatgacaaaagtgactatggtgatgatggttagatgataatggtgggggtgttggtgattatatgatggtgaaggtcaccatttattgaacactagctatattcaagacactgtatatgcaatatatcatttaattcttacataaatggagtaagaaagacatttctcctacccacaattaaagatccgaagttgagactcttgcagttaaattgatatgcccaaggtcacacagccaggactcgaaaccttgtcatcttactcagagccctgacgctaaccattacaatcacccatcctctgtgattccaagaattgccttcctctaacctccttaacatgctaaaaatgacatttaaagatttaatgctcgacatcatttcacaaggacaattaaattatattttacttcttctgtgagtgagaagtaccaagcatgaaggcactaaaagattgaagagaaattaatgacgtgttaagatagccttttgccactagcgtcttaactgctggtagttttattcaacagcaaagggaaaatgccaggaaaatttgtcctaattttctatggagagtaaaattgaaataacactcactgagatcttaataacaacactaactgagatcttaatgtgtgctaaggactatgttaggagtttgcactgattcatttaagtcttcaaccctgtaatgaaggcatcaccacatctgcagatgagaaaactacagatgatgctcagaaaggataggcggtttacccagagtcacacagccacctactcagtggaagaactgggattagacttgaagtctctttgagtttgtggtagattgtgccacatatttcagcatcacttcttgtagtgcccctcactacagaaggattattcatccccttcttggtgaactgaggtatggccatgtgacttgctttgactaattaaatgagagcagaacagaagtgcaccactactaggtagaagctttaagagagctaagctgtgctttcccacaatctccttttcctgtgccatgaaaccatcaatgttctaaaaagggggccacaccttcagcctgcactccagaggaaagacgatgtgggttaagtcacagttatgtagcacaagcaagaaataaatatttattgttttaagttgctaagattaagtgtgggaggcaaggggctatttgttattgcagcataatccactttatcctgactgacccatgctcttcaggatatgttaggatgctaaacagatgaaacccacagcatacagcataccccagcagcacctaaaccctcatccccaaatcaagacaaacccaaaatacaattataaaaggtcagggaagagtgagaacgtgaacaaccattcaattagactttgggactaggctgatgacagacaaaataattagccttacctggcgattaaggagacagtgtaccacaaagagcaacactccctgaagggtgttgatgatggtgaatgagtatgcaatgattgatccaatcgtcttccctacttcttcaaccataaaaaaaccaaggccccaagaacagcccaggataaatagctgagaaatggctttaaatgtcatgactctgcagggaataaaagtaataataactacggtttaccaggtatccactacaagtgctaactaaatgctctgtgtgcattcccttatttaaatctcacaacagcttcatgcagttaagtgacgtatacaacaaggtcacacagcttgaggatgaagtggaacccatgacttcagtcatggcaaatcactgagaatagtgctttctccccaccgttgaaaataatttgatttctctgcatgtcttctgcctagattttttggaagatttatgggaaaatgccttctagaaatttgtattaaaacatttgaataatggtgaattcctgactttagaacataacataatgttgggtttcttcacacaaagtatattgtgtttcatataatggagtgggattgttgatggcagctggctgggagagctgatgagtgtgtgtgtgtataggtgtgtgtgtgtgtgacttcactttttactttttgtgttaccccctgggaatataaactctatgagggcagggattttggtctgttttactcactgctttatctccagtccttagaacaatgcctagcacatagtagatactcaataaatattatggtttgtgataaacttgctaattagtccttcctgttcctgatttggttcctaggttttccacaactgctatctagcttggtgatttttcttacatccagccctccttccatttgcacttacagaaagatatatacttatagaaaagacagaaaacctacctatgtccacatttaggagacagcataatcactggtatatgaggattctcccatgacaactttctctttggcctaaatggtgccatatggcttcatccccactgaccatagccagttgccccacagtagacacctgacctataaggagtcaatcaatccattttccccccagccaaccagattttgtctcttaagcatttgaagtaagaggcttggagaatggacctgtgagacgcctttgaggtggctctgccctgttcatcagctgtgggaagtcagtctgcagggagaagaggacagagccaaggtgcaggaaagggagccataaatatgcgattttttttttgagatggagtcttgctctgttgcccaggctggagagcagtggcacgatctcggctcactgcaacctctgcctcctgggttcaagcgattctcctgcctcagcctcccaagtagctaggactacaggcgtgtgccaccaccatgtctggctaatttttgtatttttagtagagacggggtttcaccatgttggccaggatggtctcgatctcttgaccttgtgatccacccacctcggcctcccaaagtgctgggattacaggcatgaaccaccgcgcccagccagatatgcgattccatatcacaatggttaattctggagcttaggagacaaagggactcaagtggatgggggcttctaacagatctggaacaagtctctcaacaactctttcccagcctccccttcctgccatgatgtctgaaatttctagaatccaagtccttcctattgaaagagcatgatgtttccaccatgtcaatgttaacctcggatttattacttaggaaatagacgagatagttaatctctaccccaaagtgtgacattaacctagtgtagcacaacagggtaactgtctattcaccagcaagaggaagaggttggcagcagggcatggctgctgggatgaggtcagacatggagcttgctgtttgcagttctaaggaagaagtgagcccttacagggtaaggaattgagaaatggggggatggggaaacaccaagaagggtggcactttgaccctcaagaattgaggaaaccaaatttaagaaatgtcagactggtctgataagtagaggagtcttgagacagggtctgaaattagacagtcctttaattttcatgcacgtgactcaccaatgcaagatccttacccactcttggggtaaggatccagcatctatcaagattctattgaatattagcttttgtcatcattatttttaatagcatagattggtacccatgagaattgagtttctacaaccaaagaacatggagtccaggtagggtgcggtgtggttcatgcctgtaatcccagcactttgggaggctgaggcgggtggatcatctgaggtcaggagttcgagaccagcctgaccaatatggcaaaagcctgtctctactaaaaatacaaaaattagccaggcatggtggcgtgtgcctgtagtcccagctactcagaaagctgagacaggagaattgcttgaacccaggagaattgcttgaactcgggagtgggaggttgcagtgagacgagatggtgccgctggactccagcctaggcaaaagagtgagactcagtctcaaaaaaaaaaagaaaagaaaagaaaaagaaaaggaaagaaaacggagtccaggggcatatgggctcttggtggagtgagaggaggatgttgatactcttggaattaatttcataataagagtgtgttatacaaaggaggcacttgataaatgtttatttttcttttcttttttttttttgagaccgagtctcgctctgttgcccaggatggagtacagtgacatgatccgtagctcactgcagcctcaacctccccagctcaggtgattctccctttgcagcctcccagatagctgggactgcaggcgcacgccactatgcccagccaattttgtaaatttgttgtagagacaggggtctcagtatgttgccaggctggtcttgagcagctggactcaaacagtcctgtcacctcagcctcctcaagtgctgggattacaagtgtgagtcactacacccagcaggaatatttattgaataaggaaatgaagttacctgaaaatcagagtttctatttcttctataaattgtccttcacatgctctttatcgcgtaccagaataatttatatcatatttctgcttgggttctttctttcccaaaagagcagccacgtaggaataatgtttgggtaccactgattctgatgccttcttacctggtgtcctgaatggtggaaacttctttattgagggaggaaagtttgcttctcaaaatccacagaacttggaagtagaacaccaggtttatctgtgggaaccgcatgaaaaaagtgacttggaattttcttttggagccattttatacaatctaatttgaggagggcctaagaatcttttcccaaaagacacaggttttataaagatggtatgcacatatgttctggtctattacgtacaacacgcagcatataccctgtagcatttggtgcttgattaggtaactatcgaatttatcattcaaaccaggagactttgaaagtggaaaggtgctattaatgtctctaccagggaacaggtgtcatcagaaagtttccggcaaacaggaaaccatgtcaccctgtgtagagaagccaaccattaaatatttgttgaatggaatgaataacagcattttgaaaagaagtcccaggagaggtgatattattacatcaaagcaacaagtgagccaggaggaatccaaggaaagaaaagtggagacagtactttcaggaagaggggctgatcacattaagctgttatttcttatcttcatctcatttccccttagataagaaaaacattttgtatgcttggtcaacctaaggcgggcacacccataaataattatcgcctaccaagataatgactgctactggccccatgaagctccagatgaatcctttatcaagcttgagccaacagctgttgagacagagagaagcattagctgcctcttccttgggagaaggcagagaacttgaatacaggctcctggggcaagatgtgaacagggccaggagttacttcggtcagaatcctgaattttagatggagtcagatgtgagttctcatttgatgcaggtgcatgctctgaggctgagttttttcaagtgtataatagagctaatcaaagtactggaaagattaaatgatgaccgtagctgtctactgaggcttgaagtcagggaatgtcagttctctggcttcattgttctccttctaaatagagttggtcattctaggtcttttgcctcctttatctaaacttcagaatccgtttgtccaatatccacaaaataattttctgggaatttgatttggagtgtgttggatctatagatcaagttgggaagaagtgccatcttgacaacgttgagtcttcttatccatgaacatagaatatctatttggatatcctttgatttttttcatcagaattttgtcactgccttcatatagaacttgtaggaaagattaaataagataatgtgcttaaagtttttgagtacagttcctagcaatgagttaacggtaataaatgtagttagcaagttgataatgattgctataatgagaaagatagtaaaaacgataactacagctataaaaactaactctaattaagcatattgcatgcaccaggtactctgttgtccagataatttgtattctttcttggcttatgatggcaaaggtagcataccttatttttaaagggaagctgagagcctgaatctctaacattcagtaggcagaaaagcttccaaacttaagttctatccgaagggctgccaactatggcccacgggtctgatccagcccgccacttgctttcataagttttactgaaagacaatcaactcattcggttacatattgtcaatgctgctttcacactacatgggcaacattgagtagtcacctcagagaccttgtggccagcaaagccaaacatatttactgtctggccttttatggaaaatgttggttccaaatctttgctattgtgaatagtgtcacaataaacatacgtgtgcatgtgtctttatagcagcacgatttataatcctttgggtatatacccagtaatgggatggctgggtcaaatggtatttctagttctagatccttgaggaatcgccacactgtcttccacaatagcaacccaaatgtccatcagtgatagactggattaagaaaaggtggcacatatacaccatggaatactatgcagccataaaaaaggatgagtcaatgtcctttgtagggacatggatgaaggtggaaatcatcattctgagcaaactatggcaaggacagaaaaccaaagaccgcatgttctcactcatacgtgggaactgaacaatgagaacacttggacacagggtggggaacatcacacaccggggcctgtcgtggggtgggggtaggggggagggatagcattaggagatatacctaatgtaaatgacgagttaacgggtgcagcacaccaacatggcacatatatacatatgtaacaaacctgcatgttgtgcaaatgtaccctagaacttaaagtataattaaaaaaaaaaaaccaccaaatttccatcttccataatagaaaaaaatcagaagggagtacctaaaattgtaaaaaaaaaaaaaaaaaaaaaaaaaaaaaaaaaaaaaaaaagaaaagaaaatgttggtcaactcctctaccgttctatctccagcattctggtaggacatagagttcaagctggaaacaaagcacctctttgactttaagaggacaaagcacctctttgactttaagagggacaacattgggaggccgaggcaggcagatcacctgaggtctggagttcaagaccagcctggccaacctggtgaaatcccgtctccactaaaaaatacaaaaattagcagggcatgatagcgggtgcctgtaatcccagctactcaggaggccaagacgggagaattgtttgaaaccgggagacggttgcagtgagctgagatcacaccaccgcactctagcctgggcaggtgagcaagactctgtcgcaaaaaaaaaaaaaaaaaagggacaacagtaactaacatacatgatgttttagtgtgtgcacaacctacttcctaacccaagcaccattaacaaaatattgacttcttcaactaactgttgtgtgttgagttttgcaagcttcattactgaagcaataaaacatggctattcagactatttccttgaaaattctgacttacttgccttgcagctctgactttggggaagtttatgaaatgcactcaggcccaggtgtcctgtgcgtaagaaaataaactgctgacgtcatagggtcatggtgagaatggcatgagctactgcatagaggaagcacgatttttgatgcaccatagggctttgatagttgtaatattggtgttattctttacagtagccattgctactaccatcataaagacacacattatgcttactgagtaaatgttccataattctggggtccaactattgctgacacagcaataatcacagctgggatcccgtagcctacagggtacatgaacctcttcttgaatctgcccgtgctggtgtagttggccaccttgaggttcctgacggtgaggaagaggtgcagcccttccaggagcatccaggtgaagcaagccaggtagaggaagtgcagcagccctgcaatgatggagcacagcacctggagggaacagaagagttaggggtgtgcagcagatgtggtctgtacctgattatatgctcagcacttagcatttcctggatgtggcctggaatttcaatttgagcatctgtaacattttgcctgggggctacacattttctgaagacttctgctagccattgaagtctgtttacatcatgcatagagcagggtagaaacccaaggaatacatgtcgtgggaacagcccccaaatgtataataaacaaaaattggtagaatctaccaatctaagacatgtgctctacactgccccctggagatcctcggtggaattgagctccaaatgtctatagtggaaacatctattggctaggtgcggtggctcatgcctgtaatccccagcattttgggaggccgaggtgggtggatcacctgaggtcaagagtttgagaccagcctggccaacatggtgaaatcttatctctactaaaattacaaaaattaggcaggtgtggtggtgcacgcctgtaatcccagctacttgggaggctgaggcaggagaatcgcttgagcctgggaggcagaggttgcagtgagctgagattgtgccattgcactccagcctgggtgaaaagagtgagacttcatctcaaaaaaaaaaaaaatttcatgtgctgatgttctaatccccagtatcacagaaggtgagtgtacttggagacagggctcttcaagaggtcattatgttaaaataagttcagatatgtgggccctaatccaatacaagttatgtacatctaaaaatagattaggccgaggagggtggatcacctgaggttgggagttcaagacctgcctgaccaacatggagaaaccccctctctactaaaaatacaaaaattagccagacgtggtggctcacgcctgtaatcccagctactctggagtctgaggcaggagaatcgctggaacccgggaggcgtaagttgcgatgagctgagattgtgccattgcactccagcctgggcaacaacagggaaactccatcttaaaaaataataataaataaataaaaatttaaaaataggagattagagtgcagacacacacaaagggatgaccaagtgagaacacagggagaagatggccatcaacaagccgaggagaggcgtctcaaaaaaagccaaccctgctgacatcttgatctcagaccatgagcctccagaattgtaagaaaattaatttccattgtttaaatcactccgtttgtggtaccttgttatggcagccagaacaaatgaatatacttttatagaagtcatgcttcatgatttctcataattctccagatgtgttcacagacacaaaattttccattcaatgtgcggaataaggcttccatttctaatcgtgataacataatgaggatgggatttaccctcccacattaaacaactaaatgctaaatgacatgtatgacattatgagttacagatattggagaataggcattgaatatttatgtttacagtgatttctaaaaggagggaaaggccggacaaggtggctcacgcttgtaatcccagcactttgggaggccaaggcatgtatcaccttaggtcaggagttcgagaccagcctggccaacatggtgaaaccccatctctactaaaaatacaaaaatcagccaagtgtggtggcatgtgcctataatcccagctactcggtaggctgaggcaggaaaatcacttgaacccgggaagtggaggttgctgttagccgagatcaagccactgcattccagcctgggtgacagaacaagactctgtctaaaaaaataaaaaaaataaaaaataaaaacaaatagaaaaagaaacctaccctatcaacacatagaccgtagacttctggcctccagacctgtgagacaataaatttatattgcttaagccgtccatatggtggctcttcattatgacagctctagaaaatggagacagagaccaagttatctagaatgtatgaggcaggctgggcgcagtggctcacatctgtaatcccagcactttcggaagccaaggcgggtggatcacctgatgtcaggagtttgagaccagcctggccaacatggtgaaaccccgtctctactaaaaatacaaaaaaaaaaaaaaaaaagaaaagtagctgggcatagaggcaggcacaataatcccacctacttgggagactaaggcaggagaatcacttgaacccgagaggtggaggttgccgtgagcggaggctgcgtcattgcactccagcctgggcaacaagaacaaaactttatctcaaaaaaaaaaaaaaaaaagaatttatgaggcaaaataccacagggtagggagctacagtggggttgggaagcggggaaggggagagattggcagagggtttgattacttatcagcaaatgcttgcaaggagactaaccaaaactaggagaaggctcctaaagaggagtaggcagaacaatcttctgagttcacacagaactggaaatagcttgttcctattgtccaaatggtttgttcctattacccaattttacctgaagttctgtgtgttaggggagtctgatatacagattccctgtatgttagagcagattttctgtaaacaggctctctgtatgttagagcagactctcctaacatccagaatttcaggtaaaattatcaggagagtattatatcattaatggggccaaatgagccctagacgaaagagaattccgtgaccactctattcaatcttagaatcaagacttgaatgtatcaaactgtttccaagtcacttaattatgtcccctcaaaagcctaaaactgtttaaataatttttttgaaaagatacagcactcataatttaaaattcaccaagaatggcattcaaacaaaaaatagcaggcatgcaacaaagcaggtaaatccaatcaggtaatatacacacatcctactatttctgtctctccagaaaccctgactaacacagcctcttaactaccaaatccagcagtctctctacttggcgtttctgtttgtttttgtgtgtttgtttgtttgtttgtttgttttgttttgttttttgttttgagacagagtcttgctctgtcactcaggctagagtgtagtggcatgatctcggctcactggaacctccacctcccaggttcaagcgattctcctgcctcagcctccagagtaactgggattacaggcacgtgccaccatgcctggctaatttttgtatttttagtagagacggagtttcaccatgttggccaggctggtctggaactcctgatccacccgccttggcctctcaaagtgctgggattacaggcatgagccactgtgcccgtccttctacttggcctttcagcagaagctgatcaacctagttggcactttctgtcctttgatgtcctggacattcatctatccaggaattctcacctgcttatctttgagtcttctcgtctatctcatgtatcttcctcctcccaatctttagattacaggcgtgagccaccacgcctggcctgaatttgcttttcctgtccctgaattaactgaagttttattcaaaattttgtgtataggtacatttgtctgggaaaaagggctttagctttcaacaaaattctcagagggatccaacttcaaagatgctgagaaccattgctctggggattttcaagagaaaatagaattcaggcttaaggaagaactggtttgaagtataattggcaattaaaatgtggactaggctggggtgacttctaagcctttgtgtccccatccagaatgtggagactgtggctcctacatcctggtggtccctacctcataggtgtttgcagagggcctggcacctgtgaagaccctccttactgagtggcctctattctgagagcatggcctcaaggactctggagagaattatggagagaccacgtgtggaactttcttcctcctgtcccaacgccccctcttcctcttcctcctcctcctccctctaccgcctccttcctcctccacagagctttattcttaatccattttacttatcactgatcgttatttctgtagcttgaagtgtctccttcgtgtagaaaactccaatatccctttctcctgcttcaatctctcctgggctcaaaattcctatttccaattttctattgtatgtctcaattccagtgtctgaccagcacctctaactaacagatttaaacccgaattcattctatgtctcgctccaagtctgttcctctttctcgccatccatctacccaacctcccaaatgggagacctctaattcatccttatttctgctttctcacacacacaccacttccacatctatttgggcctcaagtcttaccaactccccttacaaacatttctaaaatctggcccacttcctttagcagtgttcatgtttttatttttttattttgttttattttttgagatggagtctccctctgtcacccaggctggagtgcagtggcatgatctccgctcactgcaacacttgcctcccgggttcaagcaattctcctgcctcagtctcccaagtagctgggattacaggtgcccgccaccacgcctagctaattttttgtatttttagtagagacggggtttcaccatgttggccaggctggtctcgaactcctgacctagtgattcacccaccttggcctcccaaagtgctgggattacaggcgtgagccaccgtgccaggcccatatttttattaactcccacttagaccattcatagccctgttgctattctttctgctgctagtttcatctcactgcagttatctttaccttcaacttttgttgtcctgataagtattttctgtcattcccagcttgaagtcctttccactgctgccttgagcagggttaggaaatcagtggctttgggccagttctggcccagtatctgtttttataagtaaagttttattagcacatggccacacacattcatttacttttatctgtggctgcttttttttttttcttttgagacaaagtctcgctctgttgcccaggctggagtgcagtggcgcaatctcggctcattgcaagctccgcctcccaggttcaagtgatcctcctgcctcagcctcccgagtagctgggatcacaggtgcccaccaaaggtctggctaattttttgtatttttagtagaggcagggtttcaccatgttagccaggctggtctcaaactcctgacctcaggtgatccacccacctcggcctcccaaagtgctcggattaggcgtgagcaaccgcacctggcctcagcacatgtttctaagctgtgaactctatggggaaagtaactgaggtagttcccctagtcccctaattattaatgtatttgcaacacaatgcctgacacacagtgggtatttttaaaatatccatcaaatgaataaataaataaaataagaggtaggattttagagcattatataaaagcatatattttcaagatgactaagtcaactccatcttacccacaatattatttttacagtttttaaaaacatcatttgaaaattttatcagagaagtaattagtaccttccgagcacttaactatgggtgaacactgatcaaattgctttgttaagtattaactcatattattgtctcaatactctgagacaaaaaaattttaagggccaaattttaagctatgcagtcaaatctctattgcaattacaccattctgccattgtagcgtaaaagcagccacaaacaatatataaatgaatagatgaggctgtgttttaataaaactttatttacaaaaacagaaggtgggccagatttggcctgaggactgtgtcttcccaacctctgcctattttcaaatgaaacaccaagaggttaaaatctggcccccaaatctcacagcgagtaaaaaataaaattggatttgaacctaaactatctccagaaaatgtacttactcttaaccataaaactatactatttctcaggaaaaaaaatttaaatataaacagagtgcttttgtaactttctagctgtgtgatcatagtgttttagggttaacaggagacttagagaaccatctagctttaaatcttcctggataatatgatggccaggatcatgataaagataaaagtgaacattgttctctgagtgattaattcataatcttttatgttttgtcttgctaagttcttactaaatcctatgattaggcccctgttttgcagaggaagtttaaaaaggggaagccacaagagatctattgtaaaacatggtgatcatagttgcatggtaacaatgtatgtattcttaaaaacttttaaaagaatacgttagtgttctcatcacaaacacacacacacacacacaataaagctgagtatgtgaggtgatgcaaatgttaattagatcaactgagccattctatgacgtataatatttcaaaacatgctgtacagaaaaaaaatatacatatactttatatttttcagtttaaaaattaaatttaaataaattaaaaggggaagtcacttcaacaggtcttacagcaagtagggtgaagagctgcgattcaagcgcagatcagtgcagcaaacccactgcccaccaaaaatgcaagcctcttccccaccctcaaatccagagtatagatttgtcactaggaagtggcttcccagacagagaccacatttcccaactgcccttgcagttatgtgttatcatgtgaccgagtcctagccaatagagtgtgaggggaagtgatatgcaccacttcatgatgtggcacatgttaacctcccccatgggaactcagccatgttcttttccccctccgggttggctgatatgtgaacaccacgatgaccttgggagctgtgtatggaaaatgacagagcctccctcaacctgagggtgcaggatagacactcttcagacctgtttgctcaccctctactgatacataaggaaaaaataactcctactgtggcaagcctgtgacattctggagttgatcctaacaaccgctaatgttaccctatttaataccatcagcctgacactccatcactttgctaaatggcccctcagaatgtaaaggtcttattccaacttctataggaggacaactgaaatggagctcatacttttcctctctacatcatcactgctgactaatgccttgctctccatcttcttgtgggacaagatggctggattcgttatggcaatgaggtaatttgggtaaattacctacctcaggctcagttctgttgatgcccgtcaggaacaggaggtgggccaggaagaggcagagggagagctctagatggagggaggtgctggtgttctggatgggccggcacaggaggaaggtgaggatggccaggaagaggcacagcagagagatggtcagccccacctgggtgatcacggtcagcacagggtcctcctgcaaaacaccaaagggggaatccattatggtgtccgatggtgttgttattttcctgaggtagtgccagatgggcttcctagttcagtccctgaaacaattgacttacctttctgagacttagtgttctcatcttcaaaatgagggcagtagtaacactcatcacacaggaatgttaaaaaccaaaacaactagaccagtgctggatacagctcttaacaaatgactaatgggagttagtgtataaatactccagctcccttgctgctcagatagaatgacccagagatgtgagttctacactgactcccagagtcccccagagggaataaattccagttacctatggtggtaactggcttgataatgctgtctgcactgacacctgtcttacttccatctcattgtctcagtcccccactagtgtttcctgtaatcccctttcaagtaagctactaccatttgactccttgtcttagaatcttttttctttttcttttcttttttttttttacatggagtcttcctctgtcaccgaggctggagtacagtggcatgacctcgactcactgcaacctccacttcctgggttcacccaattctcctccctcagcctcctgagtagctgggattacaggtgtgcactaccatgcccagctaattttgtatttttagtagagacggggtttcatcatggtagccaggctggtcttgaactcctgacctcaagtgatccacctgcctcggccccccaaagtgctgagatgacaggcgtgagacaccgcgcccgacctttagaatctttttgtaagaaatgcagaggataactcacaaattctcggacatacacaggttcacaggaatgaatcttggtaccttgggggcaagagccacgaggacggcaaagctggacagatggaagcacttgcatttggtgtaagaaccgttgctgtgcacatgagagcagccctccgtggaccagcggcctccctctgatccctcccagtagacacagatatgttttgttctcttgtcaccaggctggaaagagaatagtatgaaagtgggtctcttcctggttttattttttattttattttattttattttgagatggagtcttgctctgtcacccaggctggagtgcagtggtgtgatctcagctcactgcaacctccgcctcccaagttcaagtgattctcctgcttcagcttcccaagtagctgggactacaggtgaacactaccatgcctggctaatttttgtatttttagtagaggtggggttttgccatgttggccaggctggtcttgaacccctggcctcaagtgatccgcctgcctcggcctcccagagtgctgggattacaggcatgagccaacatgcctggcatattatttcaactttacaggttaatcacaatgcacagtgttggaaactggatcggaaatacacttgtaggggaagagtttcacatcaccacgcctgcggtgggtttattctccatctattctgcccttctctggtcagctcagcaccctggagttgaccctctgaatggcttcgccagcttccttgctatttatagaagcaaagagaggcattggtgagactcactgggtgagagaagagagagaaataaagtatttcttccctgtgccctttctgctttgagccatctccagtttctgcagagcgatccctcattcctgcctccagcttccactgagctcaatagagcttctcctccattgccttttggcttcaacgtgagaatggcatctcactgtggcaagctctggatgcctcaacacttcctttcttcctgagctttactaaagtgtgattaacaaagaagaatttgtatttatacgttttgatagatgtatacatttttaaatgattactacaatgaagctaacacatccaacacctcacatatttttgtgtgtgtgtgtgtgtgcgtggtgaatacacttgcaatgcactctctcagcagatctcaagtgtacaatacattattaagtgtagttacattgagtgttgtacattaggctgggcatggtggctcatgcctgtaatcccagcactttgggtggctgaggcaggcagatcgcctgaggtcaggagtttgagaccagcctggtcaacatggtgaaaccttgtctctactaaaaatacaaaaattagccaggcatgatggcaggtgtctgtaatcccagctactcgggaggctgaggtgggagaatcatttgaactcaggaagcagaggttgcagtgagccgagattgcaccattgcacttcagcctgggtgacagagtgagaccctgtcccttaagaaaaaaaaaaaacaaaaactattggccaggcatggtgtcttacacctgtaatcccagcactttgggaggctggggtggacggattacctgaggtcaagagttcgtgaccagcctggccaacatggtgaaaccccgtctctactgaaaataccaaaaattagctgggtgtagtggcacactcctataatcccagctactcgggaggctgaggcaggagaattgcttcagctggggagatggaggttgcaatgagccgagatgacgccactgcaccccagcctggccgacagagcgagactctgtctcaaaaaaaaaaaaaaaatcttcattcatctgttgacagatacttaggctgtttccatatctcagctagtgtgaataatactgcaataaacacgagagtgcagttatctctttgagatcctgatttcaattcttttggccacataccccaaagtggaatcgctggaacagacgataattctgtttataactttttgagaggcctctgtactgttttccataatggctgtaccacattacattttcatcagcagatctataagggttcctcttttttttttttttttttttttgccacatactgatattttaagtttttggtaatagccatcctcactgtggtgaagcaaaatctcattgaagatgcctcagcgtgtcttgtgtgttctcttacttctgaattccgtttcctacttgggaagctgactgcacctgctcaccctttaaggtactgcatggagacccagccctgggtgtttctcacctgattatggcgaaaagtcaggaacacaggttcagagagggaaattttttccttcaaaccgacggtgccgctcacaacgtaagagttcagttttacttcctgcatcccttttcgtttactaaaaaaggatgcattcagaatatccccaagagattgataagtgatagggcaactgcagtgctctctgaagaaaaaaatggaaaagaaatactgttagtggccatccatagtttggagagaaagtacagtactctctaatgtgagggtcgtagggcaggcaatgaatggctaaaactgcccttggaaatcccttaaatgctgttcaatacaccgtgtgtcgcttggggtgcagcatttttgtctacgtaatatgtattataatgccccatacattataagcggtgcaaaatatgtgcaaaatatgtgcaaattatgctcttcagagtcctaaaaatatatatgagcccttgagcattacaaccagagttgtgaggcaagatgcttgtcctcagaagggcacatggaactcacgcaggctaagaaaaccacactctctcagccttcacctcaagctcactccggggtacctaatttagtggaaaggtatgcagaatgacccactgtatttaattaattcactcattttttctctttctcatcttattacccttcctctccctgtcttccttttccccctccccttttcatgaagccaccgtttaatgtatagaggttcaggccgggcgcggtagctcacacctataatcccagcactttgggaggctgaggcaggtgggtcatctgaggtcaggatttcgagaccagcccgcccaacatggcaaaatcccatctctactaaaaatacaaaaattagccaggcgtggtggcgggtgcttgtaatcccagttactcgggaggctgaggcaggagaatcgccggaacccaggaggcggaggttgcagtgagccgagatggtgaatggagaatccgactccaaaaaaaaagaaaaaaaatcatggaggttcagtgcacacaggacacccgtatgatgggagtgtttcccaaattgcagttatccacgtgctaccatcccatttttgaccaaagctacttatcatctgtatttctatttgctccatttaaaaaatccaacgcggttgggcgtggtggctcacgcctgtaatcccagcactttgggaggccgacgcgggcagatcatctgaggtcaagagttcgagaccactttggccaacacggtgaaaccccgtctctactataaatacaaacattagcagggcttggtggcatgtgcttataatcccagctacttgggaggctgaggcaggagaattgcttgaactcgggaggcagaggctacagtgagccgagattgtgccactgcactccagcctgggcaacagagtgagagtcagtctcaacaacaacaacaaaatcaactcatttttagatccctttcctccctttccctactctaccgctcacagtaaggagtgaagattaatgaataaccaggaattttttggaggaaatgcagcagatatttcatttttaaggtaaccaggtttttctctttgaaatagtttatatgcattcattcatttatgtttcatggaaatatttatgtatcctctactgtgtgccagacattctaggaattattatacagcagtgagcaaaacagacaaaacccctgccatcagagagctgacgatgtcgtagtgagagagatgggccaccaacaaataaataaattagaaaaaatacatagtgcaggagctttgcagagacttcaggtgatgagataaagtgtgggtgaaacactatgccgtgaaggtaaaacccagcctgccacctgcttttgtaaataaagttttatagacacacagcctcactccttcactgacacatcatcaatggctgctttcacactctgatggcagagctgagtagttatgacaaaggtcatctggaacaaaaggcctaacatatttactctctggaccttgtagagaacatttgttttccaatctgtggtaaagaacaagactcggcagctcttttaaaaagggtgtacataaacgcttctcaaggaagtgttcaaggcaatctgacaccattgagtgttaccttttcagaccattacatggaaacagagcatgcatcagccagtcccttttttttttttttttttttgagacagaatctcactcttgtcacccaagctggagtgcaatggtgcgatcttggctcattgcaacctccgccttctgggttcaagcaattctccggcttcatcctcccgaatagctgggattacagtcacgcaccaccatgcctggctaatttttgtgtttttagtagagatggggtttctccatgttggccaggctggtctcaaactcctgaccttgtgatccacccgcctcaccctcccaaagtgctgggattacaggcgtgagccactgtgcccgcccagccagtcccttttaaggaggcatttcaaggaatccttatgcaaacctttgtgtatgtcacaaaatacacaccccatgtgacagcccgacttctctctgcaaaatgcctagttagtggttacggaagatcattttattccaccatgtagaatctccctaccttaaaagctttgtgaattctcaccccagggtttaatcgcctagaaataaaacaatgatgtgtagaatttggagtcaagataattcatcggagatatggtacctcttaggtttccttttaaagcatcagcacagttgatatccatggtgttatttccagcttccagaaaagcattctcccttgtctcattgcacctcttggtttcatagactgaaaacattaagaaagtcagtcctgttctcaagtctcatacctaaataatttgctaaagaactcccttttctggaagacctcctactggtgattccatctctcctatgcaaggttggccacgtggcaccttgttcccatctttggctggtagaaatggagtggccaaaatggccttagcaacacactggccacagcccaagagaggagaagggcatgcttcccagaactggtactctgataggcaagctaagcagtttccacaggacacttaatggtaccggagtccctggttaggggagaatgcaatctttataagcaagagtagctaagcatttaaatgttttccaaaaaaaaaatagtcactaggaacagaacttctgcatttgggaagaatccctgtaaacctataaacacaagagctgatcattttgtgaggtcaacctcaacattttggggtatacagagtttgtctcagaacaaatgagaaaactgtcctaggtgctatggcagactgcttattacctgtgatcaccatttacctattctttctttgcatctagaactactaaatttaagctgaagacaagccattttccagcttcccttgcagctaggcagagccatgcaactattttcaggccaacggatcaaagaacagaatggcatgtgctaagggaaacaggcatcctttcaacttctcttctccccttttcattggctggtaaaagggtgtgatagtacaacaactctcttgtatcacaaagtgaaggtgaatgttgaagacagcagagcacagagctggcatggtattgctacatcagccctgactcacttatgctcaaactattcaagaaataatggttaagctgctgtttaccacggttataccaccagatttggtatgttaattcagacactaagttcacatggaacatttgctaaaatagaccatcagtcaagtctcaacaaattcaaaaggattgaaatcctacatagtgtgtgctcagacaactcatcaaaaagagtatatatcacaactattttttcctggtaagtaagcctggtttaacatatgtaaatcaatcaatagggttcatctcattaacagaatgaaagataaaaatcatctcaattgatgataaaatgatcatctcaattgaggtaggaaaaagcatttgacaaagttcaatatcctttcttgattaaaacccacaataaattaaatgaggccattaacacaaggaaaccttaaaaagccacaaatatttggtaattcagcaacacacttctaaataaaccatgagttaaatgatagattacacaggaaatgttttaatattttgatctaaatgataatgaaagcccagtatatgaaaacttgcaggatgcagctaaagcagtgcttagagggaaatatatagctctaatttatagctaagttttaagttttaaatgcatatattgggaaaggagaatggtttaaaattagtaatctaaataaccaagacaacaagttagaaaatgaaaagcaaggccaggcgcggcgtgatggctcacgcctgtaatcccagcactttgggaggccgaggcgggtggatcatgaggtcaggagattgagaccatcctggctaacatggtgaaaccctgtctctactaaaaatacaaaaaattagccgggcgtggtggtgggcgcctgtagtcccagctattcgggaggctgaggcaggagaatggcgtaaacccgagaggcagagcttgcagtgagccgagatcgcgccactgcactccagcctgggcgacagagcgagactccatctcaaaaaaaaaaaaaaaaaaaaagaaagaaaatgaaaagcaagttccacccaaagaaagtaaaaggaaagaaataataaagaacaaaaatcaaagagaaaggaaatggaataataatataaataatcaacaaagccaaaaattggttctttgaaatgattaacagatacagaggtcagaaagaaaccagagttcctgacatagagttcctaaaacccttagagtttcctgagcaatagaatcactaggaaaatcttttgttctgatatttggtcttggactcaagttgctgacatatagtccctaagaccgttgtaatttcctgagtgacaggagtgtgtgactcaactctgaaatcctttgtactttcttggttatagaaatatcttttattctaatgtagtgactcttagccagctcctggatagcctcaggatgggggtggttgccaaggaaaccaatggtgagattaaagggttggaactttcagtttcacccccatcccagatacaggaagaggaggggggctaaatgttgagttggtatcaatggccaataatgtacccaatcgtgcctaactaacgaaccctccatacaaatccaaaagatttgttaagctgtctaggagattctagattgctgaacatgtgtgggtccccggggtggcacctctaaagagggcttggaagctctgcacctcttctcccataccttgccctgtgcatgtcttccatctggctgttcatctgtatcatttgtttatatatatatatgtgtgtgtgtgtgtgtgtgtgtgtgtgtgtgtgtgtgtatatgtgtgtgtatatatatgtatataaatgtgtgtatataaatgtgtgtatatatatacacacacatacacacatataatatatataaatatatatttatgttttatatttttattttaatatatatattttttgagatggagtctcactctgttgctcaggcttgagtgcagtggtgcaatctcagctcattgcaacctctgcctcctgggttcaagcgattctcctgcctcagccccctggggagctgggattacagatgcgtgccaccatgtccagctaatttttgtattttttttttttagtagagatggggttttgccatgttggccaggctggtcttgaactcctgacctcaggtgatccacttgcttcggcctcccaaagtggcatgacccaccacacccagcccatttgtaatatatttttaataaatggataaatgtaagtaaagtgctttcctgagttaagcgagtcactctagcaaattactcaaacccaaggaaggggtcatgggactctaatttactgcctgtcagttggacgtacgggttacaacctagaacttgggattggcatttgaggtgaagaatacttttgtgggactaagcttgcagcctgtgggatctgacgctctctttggttgataatgtcagataatgtcataattgaattgtagaacacccagctggggtccactggagaactgtgtggtcagtgtggaaaaggagcccacaataatttggtgaccagagatgaagtattccgtgttcttgttactatgtgagagtagagtaggaaaataaccgaggttttttctatcccctagccatggtggcatagcgaatatgctcttaaatactttccatcataccaagggaagttgaaaagaagaagagagctggtttattctcttgtcccttgaatttgcatttttgaaaatggagtccttctcatgtagaatgttggtgtagagggtctgtgatcctgagagcccacagatttcatcattcagaaaccctgacaaagccaggacccagacgtctttatggtctttatggagggtcataaagactctactcagcctctcttacctatatcaaattcagaaatttgaccctttcctggagaagcaaaactcgcattccagatgctcaactccacgctttgaattagttgagtagcccttcttgcaaagtcctctctgcttccatttcttctcagattttccttccaaaaaaattaagctaattagattgactcttactgaaatgtaagaaatagggaatatgcacaagtgttggagtggggagcccagaaggcaacgatatttattaaggtgctacaaggtgcgtgtggcattgagaatctaggtgcttgatgtaggtctttgaatgccagctgaggcactttccccctacgcttgtatttctctatctctatggacatgtggcactaggcacttcttgattgtgggaggctgtcctgggcactgtaggatgttgagctgtatccctggtctccatccaccagatgccagtcacacacatcacccccaaggtatgacaaccaaaagtgtccccagacattgacagatgaccttgggacagaggacaaaattacccctggatagaactaccctaccctaaaaatcacaggaagacatgttaatgtttgggtaggaaaatggcatagttatacgtaccagctgtttcccaaatccaggcttcaccccactcacccaaatatccacgtttgactgtgtcgtcccttgactattgttctctgtgaaagaaaagatgtcattgaaagagatatgggagaaaatacaccctgcttacatcccttcttctagtcaccctcaagttgagtctttccctaataattctgcagcccatcctaattcccctctaagaagcctaaaaggtattgcacagtagaattataaaagagaattagaatgggtcttccagtttcatattgagttggtgcaaaagtaatggtcatctttgccattgaaagaaatggcaaaaaccgccattacttttgcaccaacctattgctttagtcaacactgtttattcggcacctactcaataccaggcacaacgctgaactatatggatataggctaggaaaagaaaccaaggtatccccttgtggaatctgaagtctggcaggaaagtcattaagcaagttattatcaataaataattaagcaattgcaagggacgctcttaataaatagaacatgacatgtggacaaaaagatgggaactatagacagtggggactactagagggagagggtgggaggctgatgagggctgaaaagctacatatcaggtactatgcccactacccgggtgatgggaacattcttacaccaaaccccagagacacgcaatttacccacgcaacaaacctgcacatgtaccacccccaaacctaaaataaaataaaacaggacttcccaaaatcaatcaatcaataataaataggacacaatggtgtgggagtatatagcagagggtcccaacacatcagggtgacatggaagaaatcagtgttaattgagttaatattatagaagcagttgcctacacatcacagtatataacgtgccttcatatatattatctcatttcaaggaacactgaaggttgtagaaaaggcatatacagcataatatccagtattaactgacccttcctaggtgcctaggactgttaaatatttcacatacattaataatgagtaggggccgggtgcagtggctcacgcctgtaatcctagtactttgggaggccgaggcgggcggatcatttgaggtcagcagttcaaggccagtgtgggcaacatggtgaaaccctgtctctaccaaaaatgcaaaaattagccaggtgtggtggcacatgcctgtggtcccagctactcaaggctgaggtgggaggatcgcttgagcctgggaggcagaggttgcagtcagccaagatcacactactgcactccagcccgggtaacagagtgagaccgcatctcaaaaataataataatgaataggtaaggtgtattaatttgctagggtttccataatatagtgacacaaattgggtggcttaaagcaatagaaatatattgtctcatagttctggagggcagaagtccaaatcaagatgccagcaagaccatgctccctctgaaggctccagggaaacaccttgccctgcctcttccagcctctggtggttgccatcaatctctgacattccttgccctttggcagcataattccaatcttcacctctgtcttcacatggccatcttccctgtgtgtgtgtctctgtgtccaaatatccttcatcttataaggacaccagtcatgtaggattcagggtccactctgatctaatatgaccacatcttgacttattacatctacaaataccctatttccagataagatcacattcacagattccaggtggaatcagtttggggagaacactattcagcccagtaagaaggaatcagaaatggctccaaataatccctgcctcttggaattcacatccttgggtaatcttcccttgactgtggactggactaagtgactcatttctaaggaacagaatatggcaaacatgataggatgtcacttctgagagtgggttataaaagactatgactcctgtcttattcatgctctctttctggctattctaatgtgtttgctataacaaagcaagctgtagagacccacatatctaggaactaaaggctgcctcccaccagccaccagaaatgaactgagggtttcagtccaatagctctgaaggaactaaattctcccagcaaccttgtgagtagcttggaagcagaacctgccccagtcgagtctccagatgaaaccacagcctggataaaacctcaattgcaactgtgatagacccagaagcaaaagactcagctaagccatgcttagttccttaacccaaagaaactatgaaacaatacatatgtgttgttttaggccactaaatttggggataacttgttatgcagcaacacagaactgacacagtagatactattaatattactactcccatttaaagatgaggtatatagaaattaagtcattaactgaaaaccagatggtaagtggaagatttagcacttaaatcccatctctcttacccaaaaagtgaaataatactggaattaaacaaataaataaattgtggatagtgagagacaggtttctcattgttggagaaggaagctacaaataaggaaagagggaagtttccgacaagccttgatgttgaactggaaccagaggtatcagtgtgaattcgtcagatttagtagataggtagatagacataaaaattgaatttaaggtgagtgagagatgaataaatagagaaattcagaagaaatttagagctgcccttttggaagctcaggaaacagacctgtattggacacatacatttggaagcatctatatagagatagttattgatgccaaggcttggatgacaccatcttggaaaatatcatcaaagacaacaaaggaatgagggacgagggttaggatggagctttgcactcttaccctggcctgaaattagagaatctctcagagtctcccccaagtccccaccatttttcatagtggaaataggatttggaggttcttaccgtaacaatccggatgatcataatctataataccagccagaaagttgaataaagtatattttaccaaacagctacagatgtaacctccaactttattcctacaatatgctttatacttgcactttgccagcccggtttcacattcattaatatctgtgaatcaagagaaagtgttgctttcattttcatagaattataccatttcccttgcccatgaaatttttattgcccaaccattgtccatcaatgttctccctaagttaatttataaatccaatgcaattccaattttaaaaacatctacatgtattttacggggtgagagacaagttgttactatcatgcaggtgtagccagaaaaaactacaaggtgggaaccagacattaaaacaaagtataaagctgcaactaaacaaagaggtactgatgcatgcataaataaaaatagactaatggaatagactagaagtccagacacagatgcaagtacctatggagctttagaacatggtaaaggtggcatgtcaaatcactagaataaggatggaatgttgctgtttttaatgttgtttttaagtcacgccatttgctaaatcaatttaacacacatagtgcatagcaggggaataaatatacggtaagttaacacactattagaaaagcttgagagagatgaggaaggaccacactactaaaatcctggctcagccgggcacggtggctcacgcctgtaatcccagcattttgggaggctgaggcgggtggatcacctgaggtcaggagttcgagaccagcctggccaacatggtgaaaccctgtctctactaaaaatacaaaactttgctgggtgtggtggcacgtgcctgtaatcccagctactcaggaggctgaagcaggagaatcgcttgaacccaggaggcggaggttgcagtgagctgagatcgcgccattgcactccagcctgggcaacagagtgaggctctgactaaaaaaaaaaaaaaaaaaaaaaaaaggcggggcacggtggctcacacctgtaatcccagcattttgagaggccgaggcgggcggatctcgagtccaggagattgagaccatcctggcgaacatggtgaaaccccgtctctactaaaaacacaaaaaattagcaaggcatggtggcaggcgcctgtagtcccagctactcaggaggctgagatagcaaaatggcgtgaactcaggaggcggagcttgcagtgagcagagatcgcgccactgcactccagcctgggcaacagtgacttatgcaatgtttatgtgtcttgcctctcccaaccacatcagccttccgtgctgaatggaccagagctgaggttcaagcaagggacccacaggcagaaggtgctctggaccacagacttatacttgtgctctccatctgaaggactcagggacaagcacacctggccaatggctgtactttgtcaaatagtctgctgaagaggtacgggttttatttgggctatgggtttatgtgttttgggcagaggacacatggaacagaatagttatcactaatgagagattaaattaaaaccccgttaatatttttaccttcacacttctcagaggaatcatgaaagtatgtcctgccagacctggcccgaaagccatcttcacaagtacagtgggtgctgttgtggcagctggcatatttagggcatggaggacaggaagctgcagagaaacagaaatattcagtatgcatctaccacgtaccgatgctgcggtcagaagaatgtcatcttaggaatgcctctgttggcatccttttggcacccagcccattgctgaacacagtggcacacagtgcccagccgtgtcccacttctgccaccaacaccacttttgccagataggtgaacctccaaatgccggcacctgtgtttctttccttgcaggctaaccctggctaccagaattctctttgttcatcacatggcaggttaacaatgcctttcctaagtagctccctttatcaatgattgatagaagatagtgcattaaaaaaaagccaatttcattattatttaaaaaaaaaaaacagaaaataacaagtgttggtgagaatgtagagaaaatggaaccctggtgcactgctggtagaaatgtaaaatgatgcactgtctatgagacacagtatggcaattcctcaaaaaattctaaatcagaattaccatatgatcttaccatatgatccagcaatcacacttctgggaatatatgcaaaggaatcaaaagcagtgtatagaagagatatttgtccactcatgttcatatcagcattattcataatagccaaatgttgtatgtaacccaggtgcccacgaatgaataaatgaatgaacaaaatgtggtccatccacacagtagtacgttattcagcctttagaaagaaggaaattctggccgggcatgttggctcacatgcctgtaatcccagcactctgggaggccaaggtgggtggatcacctgaggtcaggagttcgagaccagcctgaccaacatggtgaaacctcgtctctactaaatgcaaaataaataaataaataaattagcctggcatggtggtgcatgcctataatcccagctacttggaaggctgaggcaggagaaacgcttgaacccgggaggtggaggttgcagtgagccaagattgcaccattgcactccagcctgggcaacaagagtgaaactcagtctcaaaaaaaaaaaaaaaggaatgaaattctttttttttttttttttttttttttttgagacggagtctcgctctgtcgcccaggccggactgtggactgcagtggcgcaatctcggctcactgcaagctccgcttcctgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatccacccgcctcggcctcccaaagtgctgggattacaggcgtgagccaccgcgcccggccaaaaggaatgaaattctgacacatgctacaccataaacgaaccttgaggacattatgctccatgaaataagccaggacaaagcgtcaaataatgtatgattccactcctatgagatccaatcccagagttgctggattcatagagacagaaagtagaatggcgggtgccagggccttggggaggaggaatggggagttcgtgtttcatagagacagagtttcagttctgcaactagaaagaacactgtgggtggatggtggtgatggttgcataacagtgcaaatgttgaatggcattgacctgtacccttgacaatggttaaaaagctacattttacgttgtgtacattttaccacaatttagaacatagtcataatcaatagcttccttacccattgaggggtacaaatctgaggtgcctgctccatgccatacccaacagctgcctccagggattaaactccagctgcccgcatctaacttgcttgataaagatcctatatgagctcctccccttcctatgccactgcccactcccagctggtgcctcctaggattccctcccagaacaacgagttgctctcagggtcggcttctgggggaacccaagcaatgacttgtggtgaaggcaaagtatttcctggaatgactcaagacacaggtttggggaaagaaagaggacagtctagcatccaccagccatgtgaccttgagccagccacttctctggaggacccttgatcaagtgggtataatgcccatgctgagtttgtaggattgttgtggggattaactgagatggcacgtgtgatgtgctttgctatgtaaatgcagatgatggtgatgatggagatgggaaaacagctcttgggacctccaaagagtcagaagaaagtgccagagactccatgctctgtctcttgaaaaagctccttccctcctccaaaggaagcttccagatcccaatttcctttcccctggcctttggctatgaatagactcacctccagaattcttggcttctgatcctggcagagccagtaagacagtgagacctggaacagagagaggaggggatcattcagacggggatcccctggactctgcgtggctgaagactaggtgagttaggggcaactaaccctaactctttgcccagtcacacgtgcaagcttcaccatagcatcttccaggcaggttacaaacacaagagtcacagatttggacatcacatccttctgaagtatgagaagtgcatctgattgcagctgtgtttcccaatttcagaaaactcagcagcaaattcagcttcttctctacatcctagcaccaaaagaccaagttggcaatctcctttccatattcaacagtttattttaatatcagtccagacctcgaaccacacactgtccgagaaaaatataatggaaaccccataggtccttttaaattttccattaccgacaattttttgtcttttgagacagagttttgctctgtcgcccaggctgcagtgcagtggcacgatctcagctcactgtaacctccgcctcctgggttcaagcaattctcccacctcagcctcccaagtagctgggattacaggcacccaccaccatgaccggctaatttttgtatttttagtagagatggggtttcaccatgttggccaggctggtctccaactcccgaccttgtgatccgcccacctcggcctcccaaagtgctgggattacagctgtgagccaccacgcctggctgacatggacatttttatgacctaaaacactcaacaccaattttcctgtgaataattttttttcagagagaaatatcacttgattcccatagggtaggggacagcaaactggacttatgagttgaggtgacttttatattttttacataaaacattttaaatggttggaaaaaaacaaaagaagaagaatacttaatggccatgaaaaccatgtgaattttagctgcctatgtctgtaaataaagttttactgacacgcagccacatccattcatttacatgaggtctatggatgctttagggctggaatagctgagttgagtagttaagacagagaccatacgggccacaaagctgaaattcaaattacctgtccctttacagaaaaaaatatgcttgccccttacatagagtatggaacatcacttacctgtaaggtctcttaacaaaccttccatccttaaactgcatctgatgcctcctatggagatttctttttctcatctctaagaccctaaagcccagaggacagggtgggaaggtctaggttgtaacttactgagctatgacgctccaagtgcggacccatttggtgtcaatccatgtagcagatactcgaagtgaccctttagcctaccccagagagggttcctataaatgcagatgactttctttttcgttctttctttctttctttctttttttttttttttttgagacagagtctcactctgtcatccagggctggagtgcagtggcggaatcttggctcactgcaacctctgccttccaggttcaagtgattctcctgcctcagcctccagagtagctaggattatgggcgtctgccaccacgcccggctaactttttttttatttttagtagagacgaggtttcaccatgttggccaggctggtttcaaactcctgaccttaagtgatccacccgtcttggcctcctaaagtgctcttcactctttcttgcgtggcctccccacaccctcctttcctgggatcccctcccaaaaaaactatttacacacatgagtccttgttttcgttctgctttggggcagcccagcctaactgactcaagaggagagtttctactaggacaggcacacgcagttattgctggagaaaatgccaaatttgaggaagcaaatcaagcgaggacaccaggggcatgaggagaaggaaagggagttctttgctccacttacctgagagcaggaccaggaggaacctgctccccatagcactgagacgccgggaacaatctctctgaagcaggacgtggtcagaatgcctggaacaaataaacctcatgaaatccaatttctgatggtcccaagttcagaagccccgtggccagtgcttatcaaaatgtaaggctgaggcaggagaattgcttgaaaccaggaggcagaggtagcagtgagccgagatcgcatcaccgcactccagcccgggcgacagagcaagactccatctcgaaaccaacaaaccaacaaaccaaccaacaaacaaaaaaaaccctttaatctctccctctcgtttgacccaataattctgcctctgggtaactctctcaaggaaaacaccctgcgaggatgatcttagcgtatttggttatagggaacaagtttatcacccaacaaatgctaaaaaaaacggatgcatctgaggaaatataaggctggaatttaaaatcctgttctatcgcagtcggcaagatcaagactgcaaaactccacaggacaaactactcactttttatttatttattattattttttttttacattgctgtcattgatttgtttatatttaatttttaaattcataaataattatatatgcttatgggctataatatgttttgacattgtggaatgattttttttttttttttgagattgagtctggctctgtcgcccaggctggagggcagtggcgcgatctcggctcactgcaagctccgcctcccgggttcacaccattctcctgcctcagcctcccgagtagctgggactacaggcgcccgccaccacgcccggctaattttttgtatttttagtagagacagggtttcaccatgttagccaggatggtctcgatctcctgaccttgtgatccacccgcctcggcctcccaaagtgctgggattacaggcgtgagccaccgcccccggctgacattgtggaatgattatatcaagacaattaacgtatgtatcacctcacatacctatcatttttcggtatgagaacttttaaaatctactctttcagccattttgaaatacacaatataggccgggaacagtggctcacacctttaatcccagcactttgggagaacgaggtgggcggatcacctgaggtcaggagttaaagaccagcctggtcaacatggtgaaaataatataatatataatatattattaatatataatatattattaatatataataaaattaatatattaatataatatgttaatgtaatacatcaatatattaatatactaaatcaatataatacattgatatattaatataatacattaatatattgatatattaatataatacattaatatattgatatattaatataatacattaatacattgatatattaatataatacattaatacattaatatattaatataatacattaatacattaatatattaataaatattaaatatatatttaatatatatttatataaaaggttactatctgttttaggaaaatgttagcattctatatacaattatccatatatgcatgtatgtgtatttatatgtgtatatacaaaatcatacatacaaatgtacaaacatataaatgcatcaaatgcatgtatatatgtatgataattttgtatttgcataaaatattcctggaaggtacctaagaaactcatagcatcggttgcttttgaaaacaaatgtatgcgaggcttaatacctaggtgatggattgataggtgcagcaaaccaccatggcacatgtttacctatgtaacaaactcgcacgtcctgcacatatatcttggaacttaaaataaagtaaaatttatttatttatttatttatttattttgagacggagtctcactctgtcgcccagactggagtgcaatggccctatctcggctcactgcaacctccgcctcccgggttcaagcggttctcctacctcagcctccccagcagctgggataacaggcacctgccaccacgcctggctaattttttgtgtttttagtagagacagggtttcgccatgttggccaggctggccctcctcagcctcccaatcccaaaatgctgggattacaggcgtgagccactgcgctcagccgaaaataaaacaagatattttaaaaagagagaaagaaagcaagtggctgggaagccgaggcaaggagacttttcagtttaccctcttctatcttttgaatcttgagccaagtgaagatcttttctgttcaaaacataaatcatttctaacagagaaaatagtggaagtactagacattactataaatgagcctttcttaccgtgtcgcccaggctggagtgcaatagcgttatctcttctcactgcaaactccgcctcctgggttcaagcaattctcctgtctcagcctctcgagtagctgggattacaggctcccgccactacgcctggctaatttttgtattttttaagtagagacagggtttcaccgtgttggtcaggctggtcttgaactcctgacctcaggtgatccacccacctgggcctccgaaagtgctgggattataggcgtgagccaccaagccaggcctaaatgagtctttcaaagaagactttaaggatcattttagtaagcgttggcctatggatatcaatttaaaatgcagaaagcactctcctaaggtaatgtcggtggccaattggggtttaagataaaacctccagtgcacattagcaaagatattgtgctctgcagatctgtgaagcctttcaaaggcgctgccaatgatgagggaggcactgatggagaagatgctttaagtagtttgcagaaaagtttcacaaaatgtaagcaggaaggaaaacaacaattacgtgtaatgcaaacaatctgatatcacatgcaaaaataatgttgtaggaggctattagaacaacatagggccgggcacggtgggtcacacctataatcccagcactttggagggcagaggcgggcagatcacttgaggtcaggagtttgagaccagcctgaccaacatggtgaaacaccgtctctattaaaaacacaaaattatccgggcaatgtggtgagtgcctgtaatcccagctacttgggaggctgagacatgagaatcacttgaacctaagaggtggaggctgcagtgagctgagatcaaaccactgcattccagcctgggtgacagagcgagactctgtctcaaaataaataaataaataaacaaccatagaaagtgattatgacgtagcattaggagcaaaaggaggttatattattctgtcattacacattgtatgcatgtatcaaaatatatcatatgtaactcataaatatgtgccactattatgtatcaatacaaaatgtaggttataaagaaagtatattacatgtaagagaatcttaaatgttaatagaagaatgtcagtatgagtgattttaaatttctcttttttcagctgtaattctaaattatgtacattgccttagcaataaaaataatataatgaagcgttttaataaaagaggaaacaaaataataataataataataattattattattattattattatttgagccagggtctcactgtgtcacccaggctggagtacagtggtgcaatcttggctcaccgcaacctccacctcccaggttcaagcaattctcctgcctcagcctcccaagcagctgggattacaggcacttaccatcaaacccagctaatttttgtatttttagtagagaacgggtttcaccatgttggccaggcaggtctcgaactcctgacctcaagtgatccacccacctcattatcccaaagtgttgggattacaggcgtgagccaccgcacccggccacaaaattactttaaaaactcttcttgggaggtctatactcctgctttgatatattcatgctgctttgatctctgagtttggaatctgttggggctgcctgtgtgtttatgtgacagttctccctccatgcttcacgcacagttacttgctggccatacactgtcagatggctttagaatttggtgcacaggcaaacctgggtttgaatcccaaatctacaactactagttaagtggccctgaggttgtgactttacctccaagcctctcgtctgcaaaacgtagctaagaaagagcacatattttacagtttcatgctgattcagtgagatgacccttcagacctgccggcacatggtaagtcctgaataaagctacctgtgaagagaagtgggaaggatgatgatggtggtagtggtggtggtggtcgtggtggatgtgatagtagtggtcatgatggtgatggtagtgatgggagtggagatcataatgatggtggaggtagtgatgaaggtggcagtggtggtgatggtactgacagtggttatgatggtggacatgatagtaatggtgatagtgatggtggcaaaagtggtggtgatggtgatggtggtgacagtgatggtggtgatggtgatggtggtgacagtgatggtggcaagggtgatggtagtaatcagggtgatggtggtgatggtgtcaatggtgatggtggtggtaataatggtgatggtagtgataggaatggtggcaatggtgatggtggtactaatggtgatggtggtaatggtgatagtggtgatggtgatgatgatggtcttggtggtggtgatgccagtggtagtaacggtgatggtggtgacgatgacgatagtgatggtggtgctgatagtgacggtgatgacagtggtggtgatggcagtgatggtaatagcgaagagggactgcatggttgtggtgatggtggcaaggatggtggaagtgacagtaatgctgatgctgatgatggtgatgaaagcggtcatggagatctctcatgtcccttccctggtgccaattgtaatcacaactttgcatgctaaggactgaccttttacccagtggtaatgagaattaacgagggtcctgtgaagtccccacaggaacacagtagtggcctaagaagacccatcccatggaaccccctattcccaagcaggcagctgcacatcatgcactggaatcctcttgcaagtcaaattttgctgcagatgcttctctcaccccttccattactgcctcctaaaatcacttacggaacttctactatgggccaagtgccttaagaactctgtggctattatcttattgaaagctacaaccatcttgtgatgtaggtttcttttgaaacggagtctctctctgtcacccagtggtgcgagctcagctcactgcaacctctgcctcccgggctcaagcaattctcctgcctcagcctcccgagtagctgggactacaggtgtgtaccaccacgcccggctaatttttgtatttttagtagagacggggtttcaccacgttggccaggctggtctggaactcctaacctcaggtgatccccccaccttggtctcccaaagtgctgggattacacgtgtgaggcaccgctcccggccatgatgtaggtcttataattatctcctaagtcttcagatgaggaaattgaggttcaaaacaatgatatcatttgcttaagattgtgctgctaggaaaatacaaagctaagatttggacaatgtcagcttgagtccaaagcccatgcacaaccacctcaccaagatcataaactccagtgtctaccaagatctagacatgcgacataaatacataaggccattggtgggacgtaataaggactgtggggaactggagaccaaaggctatctagagacacccacacccactttttccttaaatacagaaccaggagaccaaccactttcaatctctgcagtagacaatactacttcactgaaatcaatttctgttgcgggaatcttgtgtcccattggtggagttatacttgattactttctggatacctttcctctttcaaaatttgtcttctttttagagtcatgttgctccacccttcaaaaagtccactctaaaatataactggaaaattctcaatgaaaagaacccctgtccaggtaagggcatttctttgctgaggcctgatttgaaacaagtttaactaaagtgagtattttgaaaggaaaaaggtggtaagatttttcacaacagccgaggcctctagagatgctgatttgtaggggactttcggccataaccaattgtgagaaaagaatttcacatcagagagaaagagaggcagacacagagaactgagccaaggatcacacacaaagaaactcactgtttgcagcgactgatattttataattatagttgttttcatttctgcttgttgccttgttggttgttacccactaaggtggtgccatggtggtcgttacccactaaagaggaccagcctcctcctgtggatcataaccagccggttgaaaaagttgacatgtaaatccctctgctttggtcatgaataaaggacaaaacccttccaccatgataatgatgatgactgtgaggctggcatttaaacacatgtgctgatgtgtacattatgggtgtcaggtgtatggaaaagctgttaattcaccctacagacttaggaaactcgctcatctttttagatcttgttttccttgtttttcataacacgttcgttataagctatgttcatcttagactcttcttgaatcttgatcattctagttcaccttaagcccctttccacaccattgcccccttctttgtgcgtgataaggcatcccagcaggtttcagagtatcacataacaacacacacactccttgcccaagcagaagtggaaaaatgaatgtgagatagaagccgacatagcagctttcaagaaataaagtaaccggacatgtaatgaggcctccttgaaaatgtttccagaaccagaatatttttcttagattcatgatcacaagtaaaatatttcctattttctataggaagatactacttaccctaaagatgaaaagtccttgcctctcactgagtctggtagcttttcagaactgacagaagaggaagtacgtcgctctttatcttgagctccggtttctcaaggagtcttgtgggtggacacggaggctgcgttgttgtttggggagtttgcataatgcagggtctattagttctctttccactgccgtaatttaagtggtacattatcatggtggaccatatcaaagtgcctcagaaaatgaatggggaaatggtgatggtgatcagtgggaaatggagagggataatggagagtgaagccaacttccaaggatatgggttcaacttcaaagaggtctttttaatttaattttcactaccagagttgaaggccagagtgtgggaaggagtcagcatatctttgtattgcttcatttcctattccagttgaccaacttgggaaaatgactcatccatattcttggtttttgggatggtaccattgaagagaattacactgatagacttggctgataagattttcaacggtttcattagggtggtattctgaaattgttgtctcatttgtattagaagaatcttcgtggccgggcgcggtgactcacgcctgtaatcccagccctttgggaggccgaggcgggcagatcacgaggtcaggagatcgagaccatcctggctaacgcggtgaaaccccatctctactaaaaatacaaaaaattagccgggcatggtggcgggcgcctgtagtcccagctactcaggaggctgaggcaggagaatggcgtgaacccgggaggcggcggagcttgcagtgagcggagattgcgccactgcactctaggctgggcgacagagcgagattctatctcaaaaaaaaaaaaaaaaaaaaagaagaagaatcttcgtaagatccagcatgaatatggcaaatatgccctaatttggcaagtccaaatacacatcaagcaatttacttcttgtcttgattttattacatatatgaaacgtggtcttattatccctaacgttaacaccttcatctttctgttttccatttatttttataaattcatgagtaaatgcaataaattatgcaaataataacatagatatggctggatagctgggctggtaatcacctcctccatgtaccactcaaaatgtttgctgcatcatcttttttttttttgggatggagtttcttttgctcttgtcacccaggctggagtgcaatggcacaatcttggctcactgcaacctctgcctcccgggttcaagcgattctcctgccttagcctccccagtagctgggattacaggcacacaccgccacgcccagctaatttttgtgtttttagtagagacgggatttcctccatgttggccaggctggtctcgaactcctaaccttaggtgatccgcctgcatcggcctcccaaagtgttgggattacagacgtgagccaccgcgcccagcctgctgcatcatcttttaaatgacaaatgaaagacggattaagcctgccattgtcagctgtactgaagacaaaattgtctgcatgtaaaactgaaatgcctaaacccaaaggaagtccctgaaattctgagcattctgtgtgctcatagtccaattctgcacgcgatagattgcaccatgggatggaagaattctctatctttaagtgtagtctctggctctaatcttggccatgtgactggctttggccaatgaaacaacagctaacaggatgcaaaaaaaaaatgctagcctgctggagtgtaagaggccatgttgaagaaaccaaggcttgatagacaataattcatcactttggttgccaatctgccgatcaccacatgtgtgggtaaggccgtgtcagatcatctattcaaccagcatacccaccaactgataaacacgtatgaatggaacaaacaagccagctcagatctgaagaatgaccacagaatcatgaattaaatgaaatagttgttattttaagaaaaaaaaaattcaatggggagaggatggtttgttatacacccaaggccaactgagacacttcccaaggtgtcctggaataggttatttgcactcttgttgtcagacatggtattatttaactctacctcccaaccacagctgattggaacatggattggtccatatggcaaacaacaacttatgagatggccaagaagataagtgtaccttcaaacagttctgtatattgaatattgactgaccaatccattcagactgtgtctctcttgagggatctgaataagtcccagaaagggatacagacagcagcgtgactcatgagctgcaatgaacaaattaagaaacaacaaaagcagaagccgttggataggagaatctgttgatgaccttcctctccaatctctacgttgggtatctcaccttgcctcggtagagcagtacagtacactgtcaccgtcagagaaaccagcccatttcaaaacccaaggagcaaatgttcggtctaggaacgtttgatatggcctggtcatttcccaaactttaacaagcatttaacaattcactttgggcaattgtgagaaacacctgttctccatccttctgcaaccggccctgtgcattaagaggtttccctgtatgttctggatcatgaggcacttgtgtactctgctgtgaagctggatttgaccagggttagccccggaagaagaaaagacagctgatgcagctagagatggggtgtttacttctctagcttcctcttccctgccagcattgcacatttggacagaggttgggtttttctgctgtaggctaaagccctttccaggttcttataaatgctccctgccttcatgccttcaagccaacgagtggttggcttcccacattgctaatcccagggtgccattagcaatggcacccacaatcccattggattacccacattgctaatcccagggtgcctcaccatcctctgttgatttcccttagccctaccctcacctaaataaacagtcctttcattaaaccctcctcatttaactcatttgagtgggcagctgtttctccccatgtcaccaattaatacacactttggtcctgattctgcttattctagctttcttatcaactgtcatagaagaggaaacccttatttcaagaaaagaagaaaacaccattctttgaccaacatgtggaactgaaccacaaaacacaaatatcacttcctcctttgccaatcatttaagaggaattgtttctcagcaaacttcccatgccttgaaatagtggtgttcagtatgtgaattggctggaaatatggcgtaggtggtccacttggaaagaatgggatataggaatcagagcttagaacctgggctctgtcagaatggcagcccagacttgatgcctaaaaggtcatgttcagtggctcgtacgtatgatctttcttgccagttcactggacaccaatggaattatgcccttagataatattgtcacctttgtttctaacaaacctcttatgctaagtgtgcttggtgcctgagatggtattaaaacatgtccccacactttctgacattcttttctggagagctgaagtctatgtcttatctccttgtatctgggctttgtaacttcttaactaatagaactgacaatagaaaataactctatgcatcttacaggaccagatcttatcttaagacagtagtagcttctttttttttttttttttttttttttttgagacggagtcttgctctgtcgcccaggctggagtgcagtggcatgatcttggctcactgcaacctccccctctcgggttcaagcgattctccgcttcagccttccaagcagctgggactacaggcgcttgccaccacccccggctaatttttgtatttttagtagagatggggtttcaccatgttggccaggctgtctcaaactcctgacctcatgatccacccgcctcagcctcccaaagtgctgggattacaggagtgagccaccgcatccagcccatgacgttatttataaaaccaagagtgcacatgtaccctagaacttaaagtataaaaaaaaaaccaagagtgatataaaaaaaaaaaccaagagtgtctcttcaggagacagaatgtcagaataacattctgttgctgtgcagtagattgacacacggtctttcccagatgtattcattcaacaaacattataaacccaatcagtgaccccaatctcctgctaggtaatacactttcagagataaatcagacaaggaacttgtctgattatgatctaacatgatgagtattacacataaaagatcaataataactttggacacaatgaaacaaaaacgttaagtcaggaggtaaccagatgactttgaactgatgatggaaagcttttctatgagcaaaaattaaataaacttcaaattagctgggcacgggggctcatgcttgtagtcccagcactttgggacgctgaggcaggtaagatcacttgaggtcaggagtttgagaccagcctggccaacgtggtgaaaccccatctactaaaaatacaaaaattagccatgcatggtggtgggcacctgtaatcccagctactcaggaggctgaggtgggagaatggcttgaacccacaagacagaggctgcagtgagctgagatcatgccactgccctccagcctgggcgacagaacgcgacttgttctcaaaaaggaaaaaagaaaccctgtccctgttaataactcaaaaaatagctgggcatggtggcaggtgcctgtaattccagctacttgggaggttgaggcaggagaattgcttgaacctgggaggcgaggttgcagtgagctgagattgcgccactgcactccagcctgggcgacagagtgaaactgtgtctcaataaaataaaataaaataaacttgaaattactaattactatatttattttagagatagagacggggtcttgctctgttgcccaggctagagtgaagtggcatgatcaagactcactgtagccttgacatcctgggctcaagcaatcctcccacctcagcctcccaagtagctgagatcacaggtgtccaccaccatacctggctactttttggtggaggggagtagagacagagtcttgctatgttccctgggctggttgtgaactcctgggctcaagcaatcttccctctttggactcccaaagtgctgggattataggtatcagccactgtgcctggtcaaattactacatttctaatgatgtatttttacaatttgggaaagtttgggcaacttctgtgtagtcataaatgtttttctttttcttttcttttctttttttttaaattgagacagagtctcgctctgttgccaggctggagtgcagtggcatgatctcagctcactgcaacctctgcctcctgggttcaagtgattctcctgcctcagcctcctgagtagctgggactacaggcgcacaccaccactcccagctaatttttgtatttttggtagagacagggtttcaccacgttggccaggatggtctctacttcttgactttgtgctcctcctgcctcggcctcccaaagttgctgggattacaggcgtgagccaacgcgcccggctcataaatgtttttcttcaatcagacaataaaagagacatataaatttcctcccactgataacaccctactgattttaaaagcactcaaatagtagagtgttaagattatagcttgaaaatgtttttaaggctgaaataacatcgttaatggaccaggcacggtggctcacacctgtattcccagcactttgggagaccaaggtgggcggatcacctgaggtcaggagttcaagaccagcctggtcaacatggtgaaaccctgtctttactaaaaatacaaaaattagttgggcatggtggcgcatacctgtagtcccaggtacttgggaggctgaggcaggagaattgcttgaacctgggaggcggagattgcagtgagccgagatcttgccactgcactccagcctgggtgtcagagtgagactccatctcaaaaaaaaaaaaaaaaaatatatatatatatacatatatatatagaaatacagaaatatatttaaatataaatatatattacatttagttaatggttcattttcttcccagaagttgattttaaaaatattgatgaatttgcttccattaaaaccaggaaagagctgggcatggtggtgtgcacctgtattctcagctactcaggaggctgaggtgggagaatggtttgagcccaggaggtcaaggctgcagtaagcccagatcgcacaactgcactctagcctgggagacagagcaaaaacgtgactccaaaaataataaaaaataaatcttacaaaaatttaaaaacaaacaggaaattagagttttaataattttggtttggggatacataaaacatttatacaatgctttaaattctaatacactttccaatttttcagtattttttcaactaatgctctgggaggataagcgtgttgtacgtggtcaataaatatttgagtaaatggatctgtattttcttgcataccataaattattcggattataagagggtaaatttatttcatgttatatgtgtgggattacagagccacgcagtttttactgcgtctcctttctccccctagtggagacaaatgataccacagggataacagaacggcaagtgcagtttgatgatagtaagaaaaatccctgttgtggaggtcacagctttacctacttaccttaaacacaggagttttctggccaggcgcggtggctcacgcctgtaatcccaacactttaggagaccgaggcgggtggatcacctgaggtcgagagtttgaggccagcctgaccaaaatggagaatctccgtctctactaaaaatacagaattagccaggcatggtggcgcatgcccgtaatcccagctacctgggaggctgaagcaggagaatcgcttgaacccgggaggcaaaggttgcagtgagccaagatcgtgccactgcactctagcctgaatgacagaaccagactctgtcaaaaaaaaaaaaaaggaaacagagttggctaaggcgactatatcttatttatttatttattgacctttttccagtacaagtttaatattcattagaggagtttttttcatgtgatgggggagaatggcggcaagtagtaggatctgctgaaggcaggagcttcactgtgatgatggcgccccacacctcgggtttcctgcagcccaggatctgatagccggccatggtatcatcacatattttttcaacaacgatgggacatggtctgcctcatctcccggggacaccaggagcgctttccagactccgggtgatcggggagcagctcccagtatggccttagttagcgtctcctcctggcccatgttaatccataggcgccccatgatgagggctagtgagggcctctccctggagtcaacggccagaattgtgtttatgaggcattctcgttctatggaaacaaggaatgggatcgcctgtcaccattcacacagtattagtgtcgtcctcagccccacaaaagtctgcccaacagatggcagtcctcggccaccatggtgtagacagtggctcccaggctccacacgcccaccagggtacatcgtacttttgtcccggggaacagttctgaggctgtataagaggagctcccaccgaaggggatcagctttcagcctacggtgaatctggtatcaaagccagcgtctgttgtttccatgtcgtgctgagcctcctcagggaagttctctgacttcagatccctgtggataatttccttctggaagcctcactgcatggaatatcctatttgctggaacttgcctcaggcctcttcccccttcaagaagaattcgagggtgaagtcggatagctctcccgagctggcttaatccatgactaggaacagcctgttctcggtgccagccacgtgggtctgatgatcttcgggtgattaagggccttcatcatatggtccctgcagtacagaccctgggggctgcaggagccctgctgccctgttggggtgacctccacagccatcttggtcccagtgagaatgtgctgggccagctgccttgacttctgcaaagctgccctggctgatgaccttgaggagcctatgatcatcagtaagggactcctcggaggcagaagtggttccaaggccctgcagcgtggtgacctcccggctacacatctcagctaggaatgccaactgagaatactacccctacaaactttgctaaccaggaacacgaatgacacggctggaggtgtctgctgacatgtgagggtggcctctggtcacctccatgccagggacaacgttcgaggccaactctaccatggctgcacccaggaaccggatgatgtcatcaggaatcatctctcccggcctcttggccctgctgacttccctctgagttgatgtcattctcaggtgggctcttcctccaacgtggcaagatggcacccacagctccagcagcctaacggaaatagatcttctccgcccagatgtttccaagacaatgacctgacctttggcactgagtgtgtcacatgagcaggccttagccaatcactgtggacaaagaagatgggatcagcccattggccaggttgaggtcatgtggccactgtctctatggaaacttgggagatgcttaactgttttcagttgggagactctgtggtggctgagagagcaggttcaggctcgaaaggtcactacaactggatatgcaactgcagaagaatgactttggacgcctacctcacaggatatataaaaaatgaatgaaacaacagctaacaaggggccagaaagtgctagtctcctggagtgtatgatacacaaaaatcagatcaaaatcgatcagtgttataaatggaaacgttgaaactagaaagctattagaagcaaacaaagggtaattttttataaccccatctaaggtcatgaaaacccatagtgattttagagatgacaccaaattacaagcaaaaaaacaaaaagtagatacatttcagttcactattttgtacactctatgagttttaacaaatgtgtaataacctgtacccatcattatgtgtcatacagaatggtttcgctgccctgaaaatcccctgtactccacggccttagaggtctggcggtgtgagcctcgtcattgatgttttgggtggtggggaatgtaggtgtttttcagttactatcctccgctttagggcagaaaagagaggaattccccacctagccccaggttttcataaaaccataagtaatgaaggaacccaatactgcaggtgaagaaatgaatcgtcaggatatattgatccgtgggattatcatagtaaaaatagctaagaaataaggaaggagatcacattttagaacccaacaatgcagcttgaattctgcatggatcttgagctactcatttggactttgtgaattcagtgtgaatgttgcttcccaggcaatgggggacgcatgcacttgccggtgctcgtgcacacgggattggcgtgcagatgtgtgcgggccgcacaggggatgttctgcagctgccctgggccctgggtgtgtgaggctgcccccctgccatgttgaactttaaagggtgtgatgccggaatgttgttggctgagtccggactggcatgagcccttctgatcctgttacctcacaccttgcctggcatcatcccaaaaggcgtttgtgcaaatggcttattgacacgggcttgggaccaaatccacccaaggggagggggtccctggggccttgctatctgtggacttggatgaaatcatagtgcctgggggtggagaggatgaccctcagatatgttttccaactcgtgtttttcttctagatgcaggaccccagatgcagagccccagggcatagaggattccagattcttgcaggggactggaggaggctcggctgaaaggagtcagggctgcgagggtaggggacagattcgagtagtttctccatttcacagcaataattactgccccccaccacacacacacacacacacacacacacacatgcacacacatgatatatgcatacacctgtctgtgctgcaagttccccttttgctcagacttagggttttgcagacacttctaaggaaacaaagatgttcccttttatttttgtctacttgctcctgaagcttcccctccatgtgtgcaatatgactgatgccaactgctttctttctttcttttttcttttcttctctctctctctctctttttttttttgagacggaatttcactcttgttgcccaggctggagtgcagtggtgtggtctcggctcactgccacctctgcctcccgggttcaagcgattctcctgcctcagcctcctgagtagctgggattacaggtgcccaccaccacaccaggctaatttttgtatttttagtagagacagggtttcaccatgttggccaagctggtctcgaactcgtgacctcaggtgatcaacccgcttcggcctcccaaagtgctgggattacaggcatgcgccactgcgtccagcctattttttacattttaaatcaggcaattataatatatcaaacatctatattccaatcacccagaatggagaattactgaatttggttatattcactttgagtcttttaaaaataacattttacaaacaagtagtctcccgttggctccccagacaatccaatttctcttctccctgtttcccagagcaggcaaatatcattatttattcggtgtatatacttctattctgaatttcatacacatacattatatacatccaaatacatattaataacatttaagcatgtattaatatacaaaacacatatatccgttaacattacctaggattgtttagtgcatttacatttttacatatatacaaaatacgtatacttattatgtttgattctattttttggttaacttgttctttaaagatgaatctagctgggcccgaggcaggcagatcacctgaagtcaggagttcgagaccagtctggccaacatggtgaaaccctgtctctactaaaaatacaaaattagccgggtatggtggtgggcgcctgtaatctcagctactcgggaggctgaggcaggagaattgcttgaacccaggaggcagaggttgcagagagccaagatgtgccactgcactccagcctgggagacagagcaaaaccatgttaaaaaaaaaaaaaaaaagaatcctctggtcttgggaatctaatgccctatattataattcatagccagacacagagtaattacttgtttgcacccagcgttctaaccacaggaagggaatgggggaagtgggtttttgcaagaacctgctttgaggtgcacacctccacagagctaagcaatctagtctgggagataatactcatacgtgtccaggaaatgaggaacaaccagatagcacataattaaaacaccatattttatgatgcagatcatttaagaaatgtgggaggctggatgcagtggctcatgcctgtaatcccagcactttgggaggctgaggcgagtggatcaagaggtcaggagttcaagaccagcctggccaacatggtgaaaccccgcctctactaaaaatataaaaattagccaggcgtggtggcgggcacccgcaatcccagctactctggaggctgaggcaggggaatcacttgaacccgggaggcagaggttgctgtgagccgagatcatgccactgcactccagcctgggcaacaagagtgaaattccatcacacaaaaagaaagaaaaggaaaaaagaaaagaaaagaacaggaaagaaagaaagatgggatgagtcacactgcacacttgcagaagtttcaggagcaagatgacaaaaattaaagggaacatctttgtttccttagaagtgtctgcaaaaccctaagtctgagcaaagggggaacttgcagcaccagacaggtgtatgcatatatcatgtgtgaatatgtgtatgtgtgtgtggtggggggcggtaattattgctgtgaaatggagaaactactcaaatctctcccccaccctcgcagccctgactcctttcagccgagcctcctccagtcccctgtaagaatctgaaatcctctatgccctggggctctgcatctggggtcctgcatctagaagaaaaacacgagttggaaaacatatctgagggtcatcctctccacccccaggcactatgatttcatccaagtccacagatagcaaggccccagggaccccctccccttgggtggatttggtcccaagcccgtgtcaataagccatttgcacaaacgccttttgggatgatgccaggcaaggtgtgaggtaacaggatcagaagggctcatgccagtccggactcagccaacaacattccggcatcacaccctttaaagttcaacatggcaggggggcagcctcacacacccagggcccagggcagctgcagaacatcccctgtgcggcccgcacacatctgcacgccaatcccgtgtgcacgagcaccggcaagtgcatgcgtcccccattgcctgggaagcaacattcacactgaattcacaaagtccaaatgagtagctcaagatccatgcagaattcaagctgcattgttgggttctaaaatgtgatctccttccttatttcttagctatttttactatgataatcccacggatcaatatatcctgacgattcatttcttcacctgcagtattgggttccttcattacttatggttttatgaaaacctggggctaggtggggaattcctctcttttctgccctaaagcggaggatagtaactgaaaaacacctacattccccaccacccaaaacatcaatgacgaggctcacaccgccagacctctatctaaagccgtgaagtacaggggattttcagggcagtgaaaccattctgtatgacacagtaatgatgggtacaggttattacacatttgttaaaactcatagagtgtacaaaataaagagtgaactgaaatgtatctgctttttttcttgtacttttggtgtcatctctaaaatcactatgggtttttatgacctaagatatggatcataaaaaattaccctttgtttgcttctaaaagctttctagtttcaaggtttatgtttacgacactgatcgattttgagttgatttttgtgtatcataacgtgcattagactagcactttctggccccttgttaactgttgttttcattcatttttctatatcctgtgaggtaggtgtccaaagtcattctgcagttggatatccagttgtagtgaccttccgagtctgaacctgctctctcagccatcacagcgtctcccaactgagaacagctgagcagctcccaactttccatggagacagtggccacatgacctcaacatggccaatccgcagatcccatcctctttgtccacagtgattggctaaggcctgctcatgtgacacactcagtgccaaaggtcaggttgttgtcttggaaacatccgggagaagatctatttcagttaggctgctggggctgtgggtgccatcttgtcaccttggaggaagagcccacctgagaacgacatcaactcagagggaagtcagcagagccaagaggccgggagaggtgattcccggtgacatcatctggctcctgggtgcagccatggtagagttggcctcgaacgttgtccctggcatggaggtgaccagaggtcaccctcacatgtcagcagacacctccagctgtgtcattcttgcttcttgttggcaaagtttgtaggggtagtattctcagttggcattcctagctgagatgtgtagctgggaggtcaccacgccgcagggccttgggaccagttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccaggatctgtactgcagggtccatatgatgaaggcccttaatcacccgaagatcatcagacccacgtggctggcaccgagaacaggctgttcctagtcatggattaagccagctcgggagagctatccgacttcaccctccaattctccttgaagggggaagaggcctgaggcaagttccagcaaataggatattccatgcagtgaggcttccagaaggaaattatccacagggatctgaagccagagaacttccctgaggaggctcagcacgacatggaaacaacagactctggctttgataccagattcaccgtaggctgaaagctgatccccttcggtgggagctcctcttacgcagcctcggaactgttcccggaggcaaaagtacgatggactccggtgggcgtgtggagcctgggagtcactgtctacaccatggtggccgaggactgccatctgttgggcagacttttgtggggctgaggaggacactaatactctgtgaacgatgacaggagatcccgtttctcatttccatagaactagaacgcctcataaacacaattctggcccttgactccagggagaggccctcactagaccacatcatggggcgcccatgcgttaacatgggtcaggaggagacataaataaggccatactgggagctgctccccgatcacccggcgtctggaaagctctcgtggtgtccccgggagatgaggccaaccacgtcccatccttgtaggaacaaaaatgtaggaacaaaaatttttagtagagacggggtttctccattttggtcagggtggtctcgaactcctgaccacaggtgatccactcgcctcggcctcccaaagtgctgggattacaggcgtgaaccactgcgcccggcccacaacatggatttttcttactataaacatcaagctacacttgccacagtcttttaccgctgtggtctcatttgtctccaccagagggagaaaggagactcaataaaaactgcatggttctcggccgggcatggtgcctcacgcctgtaatcccagcactttgggaggccgaggcgggtggatcactgacgtcaggagttcgagaccagaccagcctggccaacatggtgaaaccctgtctctacaactactactactaataataataatacaaaaattagctggacgtggtggtgtgcacctgtgatcccagctactcgggaggctgaggcaggagaatcacttgaacccgggaggcaaaggttacagtgatccgaaatcacaccattacactccagccttgggcaacactccatctcaaaaagaaagaaagaaaaaaacctgcatggttctctattcccataaatatactgcaaaataactttgccctcttataatctgagtgatttatgatgtccaaaaaaatagattctttcactcaagaagtatttattgaccaccgacaacatgccgtttccccagaacattaaggcagttcaaaaaatattgaaaaatggaaaagtaagcatattggaacataaaacattgtttaaatatttatccccaaactattaaaaattttaatttcctgctctcaaatgtttgtaaaaacttttttattttttcatatttttggagtcaaggtcttgctctgtcacccagactggagtgtagtggtacgattacagctcactgcagcctcgacctcctgggctcaagcgatcctcccacctcagcctctggagtagctgggatgccagccaatccacatactgaataccactctttcagggcatgggaagtttgctgagaaacaattccttttacatgactgacaaaggaggaaatgatgtttgtgttttgtgcttcagttccacatgttggtcaaagaatagataatctaagatagtgttactcactcatcttgtggttggaagttggcaaccagagtgatgaattgttgactgccaagccttgtttctctcccacgtggcctcttacactccagcaggtcagcactttttgacatccagttaattgttgtttcattaagttttgtataccacatgaggtaggggtctaacttcattctttttcatttggatatccagttgtaaaagcaccatttgttaaaaatactgatttttcactttgggaggctgaggctggtggatcacttgagatcaggagtccaagaccagcctggtcaacatggtgaaaccccttctgtactaaaaatacaaaaattagccaggcatggtggcatgcccctgtaatcccagctactcaggaggctaaggcacatgaatcgcttgaacccaagaggcggaggctgcagtgagccgagactgcgccactgctctccagcctgggtgacagagtgagactgtcttttccccattgaatggtctttgtgcacttgtcaaaaaccagttagctatggatatgggtttatttctggactctcaattctaccccattgttccatgaccctatccttatttcaatatcacacctgtgattacagaatttttgtattaagtttggtaattggaaaacatgggttttccaactttgtttttctttgacaagattgtttcaaaccttgaaattctacatattaataaattataggatagtttctccatttctgcaaaaagggccactgggattttgataaggatttcattgaatctatacattgctttggattgtgttgtaatcttaattattctaagtcctctgatccatgaatatgggatgtctttccatatatttaagctttcttcattactttcagcaatgttttctagtttttagcacaaatctctcaccttttaagttaaattcatacctaggtgctctactcttttggctgttactataaataaaattatttccttaattttctctttggagaattcgtttgaagtatatagaaacacaactgagttttgcatattgatcttgtaccctggagccttaaaaatttgctctaatcattttttgtggattctttgagattgcttgtgtattggatcttgtcatctgggaatcaggataattttacttcttcctttccaatttgaatgccttttatttgcttttcttgcctaatttttctagctaaaactttcagaacaatgtttaataacgaagtgaaaatgggctccttgtcttcgtactggacttagaggtgaagcagccagtcttttgctatcaattatgatgttagctgtggtttctgatttatgtcctctatcatgttaaggaagttccctcttattatttctgaatgtgtttttattaaaaagtattggatttgatcaaatgaacagctgcatttttttaaagcatgattttttcttccttttatttttattttatttatttatttatctttgagacagagtctcgctctgtcaccaggctggagtgcagtgcagtggcatgatctcagctcactgcaacctctgcctcccagattgaagcaattctcctgcctcagcctcccgaatagctgggactacaggcgagtgccaccacgcccagccaatttttgtacttttagtagacacggggtttcaccatgttggccggaattgtctcgatctcttgacctcatgatctgcctgcctcggcctcctaaagtgctgggattacaggcgtgagccacccaccgccttcttccttttattaatgtggtagattacattgattgatttaactaaattgaatgtcctttgctttcctggggtattttccatttggacatggtatgtaatttttcaaatacgctattagatttgatttgctagtattttattggagatttttaatctgttatcttaaaggtattggtctatagttttcttgttatgtctttgtctggtgtgttaccagtgaaatgctggcctcatagaataagttacaatgtgttccctccttttctattttttgggggattttaaaggtttgatcagattcactagtgaggccatctaattgtgagcttttctttgtaggactgtttttattactaattcagccttttttcatattatagatctattcaaactttgtattttttcttgaatttgctttgttttttatttttgtttttgttttgagacaaggtctcactctgtggcccaggctggagtgcagtagcgagatcttggctcactgcaacctctgcccccttggttcaagcaattcttgtgcctcagccaccgagtagctggggttacaggtgtgcaccaccacgcctggctattttttgtatttttagtagagatggggtttcaccatgttgccaggctggtctcaaactactggcctcatgtgatccgcccacctcagcctaccaaagtgctgggattacagtcatgagccatcacacccggccttcttggatctgttttaataatttgtgcattttaaggaatttgctcatctacattacagaatttattcatgtatacttcattatattctccttttttatttctgcaaggtcagtaataatgtctccatgttcatctctaatttatttatttgcatttgccctctgtcatcgaggacagactacctaaaggtttgtcagtttgccaatcttgaagaaccaacttgtggtgtcactgattttctctgtgctttttatattctctatttcatgtacattcattctaatctttatttctttctgtctgcccacttttaatttactttgctattctttttgtagttccttgagattaaaagttagattattaatttgataccttttttcttttttgaagaaacttgttaaaggtttaaatttgcgagcaatgtttctacagaatctcacagacattgatatgttgtgtttccaatttcatttctctcaagatattttctaatttcacttgtgcattcttttttgttttgtttcgttttgtttgagatggagtctcactctgttgcccaggctgtggagtgcagtggcgcaatcttggctcactgcaacctctacctcctgggtttatgcgattctcctgcctcagcccacccctgccccaagtagctgggattataggcgcacgccaccacgcccggctaatttttgtacttttaatagagacggggtttcaccatgttggccaggctggtcttgaactcctgacctcaggtgatccacccgcctcggcctcccaaagtgctggaattacaggcgtgagccactgcgcccagccgtgcattcttctttaaaccattggttgtttatgagcctgctatttaatttccacatatctgaatttcccagcattctttttattgtgaatttctagcttctttctagagcaatcttggaagatactttgtatagtttcagttttttttaatttgctgtgacctgtcccatggcctaacatatggtctatcctggagaatgctccattgcacttgagaggggcgactgctccgctgttggtaaatgcagtgctctacgtaggctttgcgtccaagttggtctatagtttattcaaatcccccctttcatgattaatgcgctgtctgttgggtctatgcattattgcaagggccatattgatgtctccagcttttgtaaaaccatctattttccgccttaaattttgttcatctttacttcttatatttctggtctccatggtttcgtgagtacattgtcatagttttgtttcttcttactgaattgacacttttatcagcatctacagttgaaccttgaacatcttgggggtccgggcactgaccccacaccaccagcagttgaaaatccgcatataggccgggcacggtggctcacgcctgtaatcccagcactttgggaggccgaagtgggcagatcacctgaggtgaagagttcgagaccagactggctaacatggcaaaacactgtctctattaaaaatacaaaaattggccaggcgtggtggtgggcacttgtagtcccagctacttgggaggctgaggcagaagaatcgcttgaacccaggaggcggaggttgaagtgagctgagatcgtgccattgcactccagcctggtgacagagcaagactctctctctcaaaaaataaataaataaatacataataaaataaagttaaaaaaaggaaaaatgtaactacaaaacactaaatgatccttcagcatagaataatttaattacttcttgtttgaaacattatcttttgtaaaaacaaaaaaaaaattaccttttgtatacaatgttcaccatttgggtaacgagtaccctagaaacccaatccgtaccattcagcaaaatatattaataaaatcaacaaatacatgtacccctgaatctaaaaaataaaaatgaaaatgtaatttcaaaataaaaatttaatgttaaaatcagtgtactttattaaattatgtaatgtaatcatatcacttaaaaagtatataatttaattttattttttagaatttcatttaagattaaattagaatttagtaggaaaactaattaacatcaggccaggcacagtgactcacacctgcaatcccagcactttgggaggccaaagcaggcggatcacctgaggtcgggagtttgagaccagcctgaccaacatggtgaaacccgcatctctaccaaaaatacaaaattagccaggtgtggtggtgggcgcctgtaatcccagctactcaggaggctgaggcaggagaatcgcttgaacccgggaggcaggggttgcggtgagccaagatcgcgccattgcactccagcccgggcaacaagagggaaactctgtctcaaaaaaaacaagaaaagaaaagaaaagaaaagaaaaactaataaaaatcatggtaaacggacattgaggtgtacaatgacatataaaggtctccttctttgccttacgaaacccaatttctcgccacaaaaccatccactccttacactgttgcctttcaaatgcttttaataaagaactggtggggaagtacaaagtgtgacaattcatagcaggaaagaggacgggcattaaaagatagggattcaaaacccaggactgtccccactgactcaccccccaactgcggggccacaccccacagcttctcagcaccccctcctcctgcacttcatccacctgtcacatttctgcccgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggctgcgcacacgctcagcaccagctctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgttccttttgagcttcccctttcaaaagaaaagaaaatgtgaaatttcaaccaaatggagacaggagaagatcagctgtggggggcttctctcagctcagtggaatcttcccaccagcctctctttctggggaaatgtgtctcaaatggcagtgtacatcctcagcacctgcagggtttgctgaagtcagatatgtggacctgaacccaagtaagtctggggtggaacctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcgtgcactcgccaccttaaatactcactgccacacccagatcccaccttcacctgaacacctcctgctcatgaagaaaaacctcagaaacaccatgttgctttctgtttctaataagctcaattaactagagttacaccatgagagaatcttttgatgacatactgagaaagatgattaagcccctcctaagatttgaaatcctttcttgctctaaatcaattggaagactctagtctcataaagctgtttcagatacaaacataaagccttcatttctgtccttctcatttcatttctgttgtcctggcattaagattaatactaccccttacacgacccaaggtgttcccctttggagggaaaattatttagtctccttagttacagggcacttatgatgtgccaagctgtgcagtagaacccctgatccagaagtaaactgcagaaatcaccactctgttgattttcatcttggtgagaaggaagacataataaacacactaaaaacaaatttccgatagggtatcagatataattaagttccatgatgaagaagaagggagagacagagagggatggaaggaggagaaacagagaaacagaaaagaaagaaattcactacaatgaatcatgacagtgagtttagggaaggactaaccaatcatgatatttaaccagagaactaaaatttttttttaaagggaccaagcaatttctggttcaagaactttccagagagagagacaatttgaagactgcaaggccaagtaatacctcttttccttcttagtgatgttgttggacttttaaaaaatcagggctattatccccagatagctccgtgaacaaaaaattagaatattgttgaatattttgaatattacttgagtattactcaacaaatattaacacctagggtataagtttccacgagatagcatctagttttgagaacaacttgctaaactgtgaagatgttttacagaaagaaaaaggaatacaaatggacattattttggtcaatagtcaataaggatcccatactcaccagaacaggcaggcttggaaaagaggtgaacgcaggttctcccatagctgtagagttcctcctgctgaccccactcctgaggcacagacagcccttggcttgccggaaaatgcagtggcttctgcatctagctcctcttttatagagggagtgataatgcaatcagtggataatccatagggaacgccctgtctccacccattggatttgaagcatttctaaatctttatacagaaaccaatatggtgttaccaacacagaatgtcagtagaaaaagaatttaatccgtgtgtgtggcggggtggtatttacagttaatatcggcattttagatatgtttccttttcctcccattctctcaaacatctttgaaagcattctacggaaataagaatggaattgtcggccgggtgcggtggctcaatcctgtaatcccagcactttgagaggccgagtcgggcggatcacctgaggtcaggagttcgagaccagcctcaacatggagaaaccccgtctctactaaaaatacaaaattaactgggcatgatggtgcatgcctgtaatcccagctacccgggaggctgaggcaggagaatggtgtgaacttgggaggcaaaggttgcagtgagccgagatagtgccactacactccagcctgggcgacagagtgagactccatctcaaaaaaaaaaaaaaaaaaaaaaaaaaaaagagagaagaaacaaaaagaaaaacacctaataaataaacagacctaataaaaaagaaatacagtctcagcagccttggtctatgcagtgactactcagttttttcctattatttttcatgatgttttcattgtataaatcttcctggtttgatctttgaggaggcagacagatgctggctattttaccaatttggacctggggctaggaagtttaagacacaattagcttacgtatttaatcacattgtggcaatttcaatgcaccgatgcctcccctgcaaactccaatatatagacacaatataccgcgctctagcctgggcgacagagtgagactccatctaaaaaaaaaaaaagaaagatctcctattaatgaaaatgcagagagaaatgggtgttagaaaatcatattggaaaagatatttgcatgatgtgcatccagtaaagtacatcaagccagaatacagactagaaagatgtccatcaaatgaaaaaaaatactaaaaattgatgtgcaaaatgagtggaaaacttcagtaggcactattgaagagagaataaataaatggtcaatacaatcctgaacacatgcccaaattctgtttagcttcagataaacgctgatgaaaaatcactatgagatactcatatacacttctgtttggctaaaatgaaaaaatagcaatgccaagtgcagacatggctatggagcaatcataccattcacgtgtagccagtgagagtttaaatgggaagaaatgtactttatttgtatcccaacctgaacgtacattggaatctcctggagagtttgaaaaactaatggtagcacacacccctacacatttttattccactgatgttggatgcagcctaggctataggaattttacaatcccctaaagaccaaaaggacaggcaaggatgacacaccacttccctggttggtttggagtctgtggttttgaactttggtttgcagaaaacacacctgggagtgttttcacacctgggtgccttccagaccagtgtctccggatgcctacgggaggggccaggaaatcagaaatcatttatttatttatttatttatttagagtctccctctgttgcccaggctggagtgcaatgacgtgatctcggctcactgcaacctccacctcccgggtttaagcaattctcctgcctcagcctcccaagtagctgggtttacaggcccaagacaccacgcccagctaatttttttttcttggagacagagtcttgctctgttgcccaggctggagtgcaatgacgtgatctcggctcactgcaacctccacctgccaggttcaagcagttctcctgcctcagccttccaagttccaagtagctgggattacaggcgcctgccaccacatccggctattttttgtattttttttagtagagacgaggtatcaccacgtcggccaggctggtctcaaactcccgacctcaggtgatccacctgcctcagcctcccaaagtgctgggatgacaggcatgagccaccacgcccagccacgcccagctaatttttgtattcttggtagagtcagggtttcatcatgttggccaggctggtcttgtcctgacctcaagtgatctgcccacctcagcctcccaaacagaatttattgttattattatttttaagaactccaagtcctgccagggcagggtggtttacacctgttatcccagcactctgggaggccgaggcggacagatcatttgaggtcaggagtttgtgaccagcctggccaacttggtgaaaccccatctctactaaaaatacaaaaattaggccgggtgtggtggctcacgcctgtaatcctagcactttaggaggccgaggtggttggatcacttgaggtcaggagtttaagaccagcctggccaacatggtgaaacctcatcgctactaaaaatacaaaaattagctgggcgtggtggcaggtgcctgtaatcccagctactcaggaggctgaggcaggataattgcttgaacccagggggcagaggttgcagtgagccaagatcgcaccagtgcactccagcctgcacgacagagcaagactctgtttcgaaaaaaaaaaaaaatacaaaagttagctaggcttggtggtgggcacctgtaataacagtgactcgagaggctgaggcaggagaattgcttgaatccgggaggcggaatttgcagtgagctgagatcgcaccactgcactccagcctgggtgacagagccagattctatctcaaaaaaaaaaaaaaaaaaaaaaaaaggaactctaagtccttcatttctaagtcaagaagaggacatttctgtcatttcgggggtctcagattttgcagctcatttgaatttcacagtaaaatttaaaaggactggtgtctggatcccaggcaggatcatttgcatccatataatggagtttgctgaggtgctgagggagacatcagtaccttgaaattgccctacaggattaaatctgtaagctaattgtgtctttttttttttttttaatttgagacggagtcttgctctgtcgcccaggctggagtgcagtggcgcgatctcagctcactgcaagctctgtctcctgggttcacgccattctcctgcctcagcctcccgagtagctgggactacaggcccccaccaccacgcccagctaattttttttgtatttttcagtagagacggggtttcacagtgttagccaggacggtctcagctcctgacctcatgatcctcctgctttggcctcccaaagtgctgggattacaggcgtgagccaccgcacccggccctaattgtgtcttaaacttcctagtcccaggtccaaattggcaaaatagccagtatttctctgcatccccaaagatcaaaccaggaggatttacacaaggaaaagattgtgaaaaatcataagaaaaaactgagtagtcactgcagagaccaaggctgcagaaattgtattttttttatctgtttatctattaggtgttgggtgtttgtttgtttgttttgagacaaattctcactctcaccccagctggagtgcagtggcgtgatctcagatcactgcaacctccacctcccaggttcaagggattcatgtacctcagcctcccaagtagctgggattacaggtgcccaccaccatgcctggctaatttttgtatttttagtagcaacagggtttcatcatgttggccaggctggtctcaaactcctggcctcaaccaattcacctgcctcggcctctcaaagtgctgcgattagaggcgcgagccactgcacccaggtgtgtgggggttttgtttgtttgattgtttgtttgttttttgagacagagtctcgctctgttgctcaggctggagtgcagcggcgctatctcggctcactgcaagctccacctcccaggttcacgccattctcctgcctcagcctcccaagtagctgggactacaggtgccccccaccatacccggctattttttgtatttttagtagagacagggtttcaccgtgttagccaggatggtcttgatctcctgacctcgtgatccacccgccttggcctcccaaagtgctgggattacaggcgtgagccactgcgcccagcctgtgttgtttttaattgtatgtatttaaggcatacatgatgttttgatgcacgtatatgtagcgaaatgattactacaatgaagcaaaggaacatatccgtctcctgatgtaattacctttgtgtacgtgtgtgtagaaagagtagctgaaatctactctttcggcaaattcccagtatacaaggcggtattcctgaggttgttttatggggtggaagtttgccacagattggccataagcgggagtttatatctcagtctcttttcctcaattgttattgccatagaacttacatagagcaaagtgcaaaaaatcagacacatacatcttcacgaactttcacaaactgaacgcactcatgcccagcactgaaatcaatgaatagaatagcggattcatccccaggtgccttttcctgctaccccatcctgcctcccacaaaggcaccctctgttgtaacagcacctaggattagtttggctggtttttgtttcacgtgtagggaaccacatggtatgcactgtcttgggtttggattaacctcagctttgagagatcaaggcttaaggttgtgccggttgtcatttgtgagttctgattgctgtgagaagatccgatgggtgcagatgccccagtatttattcattctcctgctgttcattggctggtttctgacaagagctattatgactgcaggttctgtgccccgcagaacatgaaattggtgggcacgcatgtacaatgttgagataaatgctgtgtgcaagggaagagggtagacgtttatacggcttttggggtttgtttgagacggagtctcgatctgttgcccaggctggagtgtagtggcacgatctcggctcactgcaaccctcgcctcccaggttcaagcaattctcccacctcagcctcccaactagccgggattacaggcacccaccatcaggcctagctaatttttgtatttttgtggagatggtgtttcaccatgtttgcctggctggtcttgaattcctgatctcaggtgatctgcctgcctcggcctcccaaagtgctgggattacaagcttgagccaccgcctgtttgttcttttgagacagtctctctctcacccaggctggagtgcagtggcgcaatcttgtctcaccgcaacctccacctctgggttcaagcaattctcctgcatcagcctcccgagtagctgagactacaggcgtacgccaccatgcctggctaatttttttgtattttcaatagagaggaggtttcaccatgtcggccaggctggtctcaaactcctgacctcaagtaatccgcgcgcttcagcctcctaaagtgctgggattacaggcgtaagccactgtgcccagcctacagcttttgtttttgagacagggtcttgctctgtcacccaggctggagtgcagtagctcaatcacaactcactacagccttgatctcctgggctcaagtgatcctcccacttcagcctcctaagtagatgggactacaggcaggcatcaccatgcctgacaatgcttattttttattttttgtagagataaggtcttcctatgttgtccaagttgcttctagactactgagctcaagcgatcctcccacctctgcttcccaaaatgctgggattacaggcataaaccaccatgcctggccctatacagctttaatagatgtttgcatatagttttccaaagcggttattccaatttaaactcccactatccttacgggaaagactggtccctccataatctagtcagcacttggtgtttctgcgtttttccctttagctaagttgatatctatataatagtatctcattgtaatttttatttttttagcatttccctgaagctaaaagggttaaacatttgctcaaattttgctggtcatttaggccgggcgcggtagctcatgcctgtaatctcagcaatttgggaggccaaggcgggtggatcacttgaggtcaggagttcaagaccagcctgggcaacacggtaaaaccctgtttctactcaaaatacaaaaattagctggacgtggtggtgggagcctgtaatcccacctactcaggaggctgaggcaggagaatcgcttgaacccagaaggcagagttgcggcgagccaagatcgtgccactgcactccagcctgggtgacagaacaagactccacctgaaaattaataataataataatgatgataataattttttacggtcacttgtttatattcttttgtgtaggatccattcaagtttttcacccagtttcaagtgtgttttcattatttttctctgtttgtttgacattattctcttttttttaaatattaagattttttttatatatatactctggcttgatgtactttcctgggggtacaggatccaaacctcttcccccactccggttttccacgctttctctcttactgatgtatttgaatgaatagttgctcttaatgtatcttaatatggttcaaatttgaattttctcctttctatttagagtttcattgtatcaagaaggcagattatctcctcattgactgtgaagctgttcttctacctagtttttaattaaagctatttactgtgttttatacttagaactgaaactaagagtataagaaattaggccaggcacggtggctcacgcctgtaatcctagcactttgagaggccaaggcaggtgaatcacttgaggtcagtagttcgagaccaccctggccaacatggtgaaaccccgtctcgacaaaaaatacaaaaataagctgggtgtggtggcatgtgcctgtagtcccagctacttgggaggctgaagcaggagaatcattgaacccgggaggcagaggttgcagtgagctgagatcccgccactgctctccagcctgggtgacagagtgagaccccatctcgaaagaaaagagagaaaagaaaggaagacaggaaggaaggaagacaggaaggaaggaaggaaggaaggaaggaaggaaggaaaattaaaatgagactgaacctagaaaaaaggtagattagcaaagtggaacaaggttcaagagcaaatattcccaccaaagcatgaacaacattggaaacttcagagacaagtgggatgtgattaaaagaagagtagagagaacttggacaagaatggatatcagaagtgaaggatacatatgcaccttccaaaccaatgaaagacatcaacccacagatgcaattgactccacaccctctaggcaaaggaaatacacaggaagcaataatgagctacactgtggcctacaaaccaaccacaacgagaaagagtttagagaatgtggaaagcaaagaagcaaggaaaagcctgacagctgacatctcaacacaggtaaaatgagatagacatcagtggggcaccatttctaatatgctgaaagaaatttgtcaaaccagacacccgtacctgacagcaatattgcccccaaataaagatgcctaaataaaagtgtaaaggaaaacaattagttgttagcagcattgaattagaagaaaaatactagaatgaattctcaagtccacagggaaataatcccagattgaatgctagaaatgcagaaaggaacaaagatgaatgcacaagataagctgtaggtaaatattagtgcatattgctttatgaagcaatactagaaatgtctcctggagagtaaaatatgtgtagaattaatatgcatgagaatggtaatacaaaagtcagaaacagctaaaaagagaattaaaagtgttctaaagtattagcattttgtgggaggggttaaagtaattaattgtatcagagtatatgatttaattattagcataactacacagatttgtatggctgtaactagcaagttcatggagataacaataaaataataaacatatttaattcaaagtcagtcaagtaaaggcaaaaggaacgtgagtcagttaagtcaaaacctaggaaaaatgagatgattgaaacaatttcaaatttactggtaattatattaaatgtaaatgcacgaaatagaacttttttttttttttttttttgagatggagtctcactctgtcgcccatgctgagctgcagtggtgcgatctcggctcaccgcaacctctccctcccaggttcaagcgattctcctgcctcagcctcccgagtagctgggattacaggtgcatgccaccacaccagggtaagttttgtatttttagtagaaatggggtttcaccatgttggccaggctggtctcgaactcttgacctcaggtgatctacctgccttggtctcccaaagtgctgggattataggcgtaagccacctctcccggccaaagtagtaatttctttgcaacaactgtgtgatatattctataggattgtgaataaaagttttgggctttcttttcttaaagaacatttaaatggtctttagttgttgttattaaatcaaatattacgtgaacatttatgtacatagacaattccattcctatttctatagaaagtattcaaagatgtttggaaaactgggagaaaaagggaaacatatctaaaatgctgatattaactgtaaataccaccccgccacacacacatacacacgtattcaattctttctctactaacactctgtgtaggtaacaccacattggtttctgtataaagatttagaaatgcctcaaatccaatgggcggagacagggtgttccctgtggattatccactgattgcattatcactcgctttctctataaaaaggggaaccagatgcagaagtcactgcattttccggcaagccaagggttgtctgcatctcaagagtggggtcagcaagagaaactctacggctatgggagagcctgcgttcacctcttttccgagcccacctgttctggtgagtacgggatatttattgattacaggaatgtccatatgtgtcctttttccttctgtaagacagctttacagttagcagtgggttgttcttaaaactggatgttgtggaacgttatacctcaggtgttaatatctgttgaataatgttcaaagtattctcatttttgcccatgaaactgtatggggataatagctttgaattttttttaaaaatccaacatcactaggaaagggaagaagtatgatttggccttgcagtcttcaaattgtctccttctctggaaagctcctgaaccagaaattgcttggtccgtttttttaaaaaaacaaaaaacaaaaaaaattagttctctggtaaaatttcatgatgagttgcttattccctaaactcactgtcacgattcattgtagtgaatttcttttctgtttctctgtttctcctccttccatccctctctgtcactcccttcttcttcatcatggaacttacttatatctgatattccaccagaaatttgtttttagtgcgtttattatgtcttccttctcaccaagatgaaaatcaacagagtggtgatttatgaagtttacttctggatcaggggttctactgcacagcttggcacatcataagtgccccgtaactaaggggactaaataattttccctccaaaggggaacatcttgggtcagtattaatctttatgccaggggtactgtaaggggtagtattaatctttatgccaggacaacgaaaaatgaaatgaggaggacagaaacaaaggctttaaaatggaaagtgcactgatgaggtttgtgggggaaacagctttatgagactagagtcttccaattgagttagagcaagaaaggacgtcaaatcttaggaggcgcttgatcatctttctcagtatgtcatcaaaagattctctcatggtatacctctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctagggtccaccccagacttacttgggttcaggtccacatatctgactttagcaagccctgcaggggctgaggatgtacactgccatttgagacacatttccccagaaagagaggctggtgggaagattccactgagctgagagaagccccccacagctgatcttctcctgtctccagttggttgaaatttcacattttcttttcttttcttttgaaaggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacaggtgggtgaagctcagtcctgggctttcggtccctttcttttaatgcccatcctcattcctactctgaattgtcacacttttcccttccccaccagttctttaataaaagtatttgaaaggcaacaggtgtaaggagtggatgtttttgtggtgagaaattgggttttatgggatgaggaaggagacctttacatgtcactgtacatctcagtttctgtttaccatgattttaattaattgtttttttttgtttgtttgtttgttttgagacggagtcttgctctgttgcccaggctggagtgcaatggcgcgatctcggctcactgcaacctccacctcccgggttcaagtgattctcctgcctcagcttcccgagtagctgggattacaggtgcccaccaccatgcccggatattttttgtatttttagtagagatggggtttcaccatgctggccaggctggtcttgaactgctgacctcagcaatctgcccacctcggccttccaaagtactgggattacaggcataagccaccttgcctggccgttaattagtttttgtattaaattctaatttaatctttggcctggcgctgtggcttatgcctgtagtcccagcactttgggaggcggagcagggcagatcgtctgaggtcaggagttcaggaccagcctggccaatatggcgaaaccccatctctactaaaaataactaatcaggtgtgggggcggatgcctgtaatcccagctactggagaggctgaggcaagagaattggttgaaccaaggaggcagaggttgcagtgagccaaaatggtgccactgtactccagccttggtgaaactttgtctcaaaacaaaaattccaatttaattttcaaatgaagtcctttaaaaatgaaatgaaattctgtaattttaaatgaaacgaatacattacattataatttgttaaaaatgtattacattttcatttttaaattgagttttcattgtttgaaattttcgaattaggggaacatgtacatgtttgttacatggatatatcgcttaacggtgggggttgcttttgtagtttatgggttacccaaatactgaatatcgtacccagtagctaagttttcaacccatgggtaaactcaattaacctagcctgaaggattattcagtgtttagacattacattttctccctatagtatacgttctcaaggcgaagttggtacgtatcccaagattttttttttaatgaaacatttttaccccatttactctgatgtggttatcagacattttgtgcctgtatcaaaatatctcacgtaccacataaatatatacacatactacgtccctgcccgctgtttgactttgagtttccttacctctttatcattgatcgaaacatggaatggaatacctcatggtaattattttatgcatctcgggttaggtggaaactactggttgttttcactctagcagagttagggtggcaggaagtgcccatcagcagatgctactgcacaccagcccgggcgacagagcaagactctgtgtctaaaaatagatatataatttatatataattataaatacattatatataatttatacataattataaatacattatgtataataaaattatatactatataattatattatatactataatatatttcttatataattatattataatataatttatatgttatataattatattttatattataatataatgtatgttatataattatattttatattataatataatttatatgttatataattatattatatattataatacaatttatatgttatataattatatattataatataatttatatgttatataattatattatatattataatataatttatatgttatttaattatattataaattataatataatttatatagtatataattatacatattatatattaaaatataatttgtatattatataattatatatattaaaatataatttatatattatataattatatatattatgtattataattatatttatatattatatttatataattatatgtaatatatttaattatataatataattatataatatatacgtatattacataattatgatatataattatatataattatattatatatattatattattataatataatatatataatattatattatataattatatatattatatatatatattatatattataatattatatataatatatattatatatatattatattatatatatataatatattatattatatataataattataaaatataatatatattatattatataatatataattatacataactatattatatataatatataatataatataatatgaaataattttatataattatattatattatatatattatatattatatattacatattatatatattatatataatatatactatataatataataaaatatatattatacataatatataatataataatatataattatatataatatatataatatactataatataattatatataattatatataatacagttatgtataattatatattatataatataatatatattatattatataattataatatatataattatatataattatataatataccgatatagtatatattatacaattatattatataattatataaatatgatatataaatataattataatatataatatataattacataatatataaattatatattaatatataatatatgtaagtatataatatataaattatattatatatataatataattatataacatataaattatattatatatataatataattatataacatataaattatattatatatataatataattatataacatataaattatattatatatataatataattatataacatataaattatattatatataatataattctataacatataaattatattatatataatataattatataacatataaattatattatatataatataattatataacatataaattatattatatataatataattatataacatataaattatattatatataaaatataattatataacatataaattatattataatataaaatataattatatcacgtataaattatattataatataattatataagaaatatattatagtatataatataattatatagtatataattgtattatacataatgtatttataattatgtataaattatatataatgtatttataattatatataaattatatataatgtatttataattatatataaattatatataatgtatttataattatatataaattatatatttatttttagacacagagtcttgctctgtcgcccgggctggtgtgcagtagcatctgctgatgggcacttcctgccaccctaactctgctagagtgaaaacaaccagtagtttccacctaacccgagatgcataaaataattaccatgaagtattccattccatgtttcgatcaatgataaagaggtaaggaaactcaaagtcaaacagcgggcagggacgtagtatgtgtatatatttatgtggtatgtgagatattttgatacaggcacaaaatgtctgataaccacatcagagtaaatggggtaaaaatgtttcattaaaaaaaaaatcttgggatacgtaccaacttcgccttgagaacgtatactatagggagaaaatgtaatctctaaacactgaataatccttcaggctaggttaattgagtttacccatgggttgaaaacttagctactgggtacgatgattagtatttgggtaacccataaactacaaaaccaacccccaccgttaagcgatatatccatgtaacaaacatgtacacatgtacccctaaatcgaaaatttcaaacaatgaaaactcaatttaaaaatgaaaatgtaatacatttttaacaaattataatgtaatgtattcgtttcatttaaaattacagaatttcatttcatttttaaaggatttcatttgaaaattaaattggaatttttgttttgagacaaagtttcaccaaggctggagtacagtggcaccattttggctcactgcaacctctgcctccttggttcaaccgattctcttgcctcagcctctccagtagctgggattacagacatccgcccccacacctgattagttatttttagtagagatggggtttcgccatattggccaggctggtcctgaactcctgacctcagacgatctgccctgctccgcctcccaaagtgctgggactacaggcataagccacagcgccaggccaaagattaaattagaatttaatacaaaaactaattaacagccgggcaaggtggcttatgcctgtaatcccagtactttggaaggccgaggtgggcagattgctgaggtcagcagttcaagaccagcctggccagcctggtgaaaccccatctctactaaaaatgcaaaaaatatccgggcatggtggtgggcacctgtaatcccagctactcgggaagctgaggcaggagaatcacttgaacccgggaggtggaggttgcagtgagccgagatcgcgccattgcactccagcctgggcaacagagcaagactccgtctcaaaacaaacaaacaaacaaaaaaaaacaattaattaaaatcatggtaaacagaaactgagatgtacagtgacatgtaaaggtctccttcctcatcccataaaacccaatttctcaccacaaaaccatccactccttacacctgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggatgcgcacacgctcagcaccagctctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtatcactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccactcttgagatgcagacaacccttggcttgccggaaaatgcagtgacttctgcatctggttcccctttttatagagaaagcgagtgataatgcaatcagtggataatccacagggaacaccctgtctccgcccattggatttgaggcatttctaaatctttatacagaaaccaatgtggtgttacctacacagagtgttagtagagaaagaattgaatacgtgtgtatgtgtgtgtggcggggtggtatttacagttaatatcagcattttagatatgtttccctttttctcccagttttccaaacatctttgaatactttctatagaaataggaatggaattgtctatgtacataaatgttcacgtaatatttgatttaataacaacaactaaagaccatttaaatgttctttaagaaaagaaagcccaaaacttttattcacaatcctatagaatatatcacacagttgttgcaaagaaattactactttggccgggagaggtggcttacgcctataatcccagcactttgggagaccaaggcaggtagatcacctgaggtcaagagttcgagaccagcctggccaacatggtgaaaccccatttctactaaaaatacaaaacttaccctggtgtggtggcatgcacctgtaatcccagctactcgggaggctgaggcaggagaatcgcttgaacctgggagggagaggttgcggtgagccgagatcgcaccactgcagctcagcatgggcgacagagtgagactccatctcaaaaaaaaaaaaaaaaaaaagttctatttcgtgcatttacatttaatataattaccagtaaatttgaaattgtttcaatcatctcatttttcctaggttttgacttaactgactcacgttccttttgcctttacttgactgactttgaattaaatatgtttattattttattgttatctccatgaacttgctagttacagccatacaaatctgtgtagttatgctaataattaaatcatatactctgatacaattaattactttaacccctcccacaaaatgctaatactttagaacacttttaattctctttttagctgtttctgacttttgtattaccattctcatgcatattaattctacacatattttactctccaggagacatttctagtattgcttcataaagcaatatgcactaatatttacctacagcttatcttgtgcattcatctttgttcctttctgcatttctagcattcaatctgggattatttccctgtggacttgagaattcattctagtatttttcttctaattcaatgctgctaacaactaattgttttcctttacacttttatttaggcatctttatttgggggcaatattgctgtcaggtacgggtgtctggtttgacaaatttctttcagcatattagaaatggtgccccactgatgtctatctcattttacctgtgttgagatgtcagctgtcaggcttttccttgcttctttgctttccacattctctaaactctttctcgttgtggttggtttgtaggccacagtgtagctcattattgcttcctgtgtatttcctttgcctagagggtgtggagtcaattgcatctgtgggttgatgtctttcattggtttggaaggtgcatatgtatccttcacttctgatatccattcttgtccaagttctctctactcttcttttaatcacatcccacttgtctctgaagtttccaatgttgttcatgctttggtgggaatatttgctcttgaaccttgttccactttgctaatctaccttttttctaggttcagtctcattttaattttccttccttccttccttccttccttccttccttccttccttccttcctgtcttccttccttcctgtcttcctttcttttctctcttttctttcgagatggggtctcactctgtcacccaggctggagagcagtggcgggatctcagctcactgcaacctctgcctcccgggttcaatgattctcctgcttcagcctcccaagtagctgggactacaggcacatgccaccacacccagcttatttttgtattttttgtcgagacggggtttcaccatgttggccagggtggtctcgaactactgacctcaagtgattcacctgccttggcctctcaaagtgctaggattacaggcgtgagccaccgtgcctggcctaatttcttatactcttagtttcagttctaagtataaaacacagtaaatagctttaattaaaaactaggtagaagaacagcttcacagtcaatgaggagataatctgccttcttgatacaatgaaactctaaatagaaaggagaaaattcaaatttgaaccatattaagatacattaagagcaactattcattcaaatacatcagtaagagagaaagcgtggaaaaccggagtgggggaagaggtttggatcctgtacccccaggaaagtacatcaagccagagtatatatataaaaaaaatcttaatatttaaaaaaaagagaataatgtcaaacaaacagagaaaaataatgaaaacacacttgaaactgggtgaaaaacttgaatggatcctacacaaaagaatataaacaagtgaccgtaaaaaattattatcatcattattattattattaattttcaggtggagtcttgttctgtcacccaggctggagtgcagtggcacgatcttggctcgccgcaactctgccttctgggttcaagcgattctcctgcctcagcctcctgagtaggtgggattacaggctcccaccaccacgtccagctaatttttgtattttgagtagaaacagggttttaccgtgttgcccaggctggtcttgaactcctgacctcaagtgatccacccgccttggcctcccaaattgctgagattacaggcatgagctaccgcgcccggcctaaatgaccagcaaaatttgagcaaatgtttaacccttttagcttcagggaaatgctaaaaaaataaaaattacaatgagatactattatatagatatcaacttagctaaagggaaaaacgcagaaacaccaagtgctgactagattatggagggaccagtctttcccgtaaggatagtgggagtttaaattggaataaccgctttggaaaactatatgcaaacatctattaaagctgtatagggccaggcatggtggtttatgcctgtaatcccagcattttgggaagcagaggtgggaggatcgcttgagctcagtagtctagaagcaacttggacaacataggaagaccttatctctacaaaaaataaaaaataagcattgtcaggcatggtgatgcctgcctgtagtcccatctacttaggaggctgaagtgggaggatcacttgagcccaggagatcaaggctgtagtgagttgtgattgagctactgcactccagcctgggtgacagagcaagaccctgtctcaaaaacaaaagctgtaggctgggcacagtggcttacgcctgtaatcccagcactttaggaggctgaagcgcgcggattacttgaggtcaggagtttgagaccagcctggccgacatggtgaaacctcctctctattgaaaatacaaaaaaattagccaggcatggtggcgtacgcctgtagtctcagctactcgggaggctgatgcaggagaattgcttgaacccagaggtggaggttgcggtgagacaagattgcgccactgcactccagcctgggtgagagagagactgtctcaaaagaacaaacaggcggtggctcaagcttgtaatcccagcactttgggaggccgaggcaggcagatcacctgagatcaggaattcaagaccagccaggcaaacatggtgaaacaccatctccacaaaaatacaaaaattagctaggcctgatggtgggtgcctgtaatcccggctagttgggaggctgaggtgggagaattgcttgaacctgggaggcgagggttgcagtgagccgagatcgtgccactacactccagcctgggcaacagatcgagactccgtctcaaacaaaccccaaaagccgtataaacgtctaccctcttcccttgcacacagcatttatctcaacattgtacatgcgtgcccaccaatttcatgttctgcggggcacagaacctgcagtcataatagctcttgtcagaaaccagccaatgaacagcaggagaatgaataaatactggggcatctgcacccatcggatcttctcacagcaatcagaactcacaaatgacaaccggcacaaccttaagccttgatctctcaaagctgaggttaatccaaacccaagacagtgcataccatgtggttccctacacgtgaaacaaaaaccagccaaactaatcctaggtgctgttacaacagagggtgcctttgtgggaggcaggatggggtagcaggaaaaggcacctggggatgaatccgctattctattcattgatttcagtgctgggcatgagtgcgttcagtttgtgaaagttcgtgaagatgtatgtgtctgattttttgcactttgctctatgtaagttctatggcaataacaattgaggaaaagagactgagatataaactcccgcttatggccaatctgtggcaaacttccaccccataaaacaacctcaggaataccgccttgtatactgggaatttgccgaaagagtagatttcagctactctttctacacacacgtacacaaaggtaattacatcaggagacggatatgttcctttgcttcattgtagtaatcatttcgctacatatacgtgcatcaaaacatcatgtatgccttaaatacatacaattaaaaacaacacaggctgggcgcagtggctcacgcctgtaatcccagcactttgggaggccaaggcgggtggatcacgaggtcaggagatcaagaccatcctggctaacacggtgaaaccctgtctttactaaaaatacaaaaaatagccgggtatggtggggggcacctgtagtcccagctacttgggaggctgaggcaggagaatggcgtgaacctgggaggtggagcttgcagtgagccgagatagcgccgctgcactccagcctgagcaacagagcgaaactctgtctcaaaaaacaaacaaacaatcaaacaaacaaaacccccacacacctgggtgcagtggctcgcgcctctaatcgcagcactttgagaggccgaggcaggtgaattggttgaggccaggagtttgagaccagcctggccaacatgatgaaaccctgttgctactaaaaatacaaaaattagccaggcatggtggtgggcacctgtaatcccagctacttgggaggctgaggtacatgaatcccttgaacctgggaggtggaggttgcagtgatctgagatcacgccactgcactccagctggggtgagagtgagaatttgtctcaaaacaaacaaacaaacacccaacacctaatagataaacagataaaaaaaatacaatttctgcagccttggtctctgcagtgactactcagttttttcttatgatttttcacaatcttttccttgtgtaaatcctcctggtttgatctttggggatgcagagaaatactggctattttgccaatttggacctgggactaggaagtttaagacacaattagggccgggtgcggtggctcacgcctgtaatcccagcactttgggaggccaaagcaggaggatcatgaggtcaggagctgagaccgtcctggctaacactgtgaaaccccgtctctactgaaaaatacaaaaaaaattagctgggcgtggtggtgggggcctgtagtcccagctactcgggaggctgaggcaggagaatggcgtgaacccaggagacagagcttgcagtgagctgagatcgcgccactgcactccagcctgggcgacagagcaagactccgtctcaaattaaaaaaaaaaaaaaaagacacaattagcttacagatttaatcctgtagggcaatttcaaggtactgatgtctccctcagcacctcagcaaactccattatatggatgcaaatgatcctgcctgggatccagacaccagtccttttaaattttactgtgaaattcaaatgagctgcaaaatctgagacccccgaaatgacagaaatgtcctcttcttgacttagaaatgaaggacttagagttcctttttttttttttttttttttttttgcgatagaatctggctctgtcacccaggctggagtgcagtggtgcgatctcagctcactgcaaattccgcctcccggattcaagcaattctcctgcctcagcctctcgagtcactgttattacaggtgcccaccaccaagcctagctaacttttgtattttttttttttttcgaaacagagtcttgctctgtcgtgcaggctggagtgcactggtgcgatcttggctcactgcaacctctgccccctgggttcaagcaattatcctgcctcagcctcctgagtagctgggattacaggcacctgccaccacgcccagctaatttttgtatttttagtagcgatgaggtttcaccatgttggccaggctggtcttaaactcctgacctcaagtgatccaaccacctcggcctcctaaagtgctaggattacaggcgtgagccaccacacccggcctaatttttgtatttttagtagagatggggtttcaccaagttggccaggctggtcacaaactcctgacctcaaatgatctgtccgcctcggcctcccagagtgctgggataacaggtgtaaaccaccctgccctggcaggacttggagttcttaaaaataataataacaataaattctgtttgggaggctgaggtgggcagatcacttgaggtcaggacaagaccagcctggccaacatgatgaaaccctgactctaccaagaatacaaaaattagctgggcgtggctgggcgtggtggctcatgcctgtcatcccagcactttgggaggctgaggcaggtggatcacctgaggtcgggagtttgagaccagcctggccgacgtggtgatacctcgtctctactaaaaaaaatacaaaaaatagccggatgtggtggcaggcgcctgtaatcccagctacttggaacttggaaggctgaggcaggagaactgcttgaacctggcaggtggaggttgcagtgagccgagatcacgtcattgcactccagcctgggcaacagagcaagactctgtctccaagaaaaaaaaattagctgggcgtggtgtcttgggcctgtaaacccagctacttgggaggctgaggcaggagaattgcttaaacccgggaggtggaggttgcagtgagccgagatcacgtcattgcactccagcctgggcaacagagggagactctaaataaataaataaataaataaatgatttctgatttcctggcccctcccgtaggcatccggagacactggtctggaaggcacccaggtgtgaaaacactcccaggtgtgttttctgcaaaccaaagttcaaaaccacagactccaaaccaaccagggaagtggtgtgtcatccttggctgtccttttggtctttaggggattgtaaaattcctatagcctaggctgcatccaacatcagtggaataaaaatgtgtaggggtgtgtgctaccattagtttttcaaactctccaggagattccaatgtacgttcaggttgggatacaaataaagtacatttcttcccatttaaactctcactggctacacgtgaatggtatgattgctccatagccatgtctgcacttggcattgctattttttcattttagccaaacagaagtgtatatgagtatctcatagtgatttttcatcagcgtttatctgaagctaaacagaatttgggcatgtgttcaggattgtattgaccatttatttattctctcttcaatagtgcctactgaagttttccactcattttgcacatcaatttttagtattttttttcatttgatggacatctttctagtctgtattctggcttgatgtactttactggatgcacatcatgcaaatatcttttccaatatgattttctaacacccatttctctctgcattttcattaataggagatctttctttttttttttttagatggagtctcactctgtcgcccaggctagagcgcggtatattgtgtctatatattggagtttgcaggggaggcatcggtgcattgaaattgccacaatgtgattaaatacgtaagctaattgtgtcttaaacttcctagccccaggtccaaattggtaaaatagccagcatctgtctgcctcctcaaagatcaaaccaggaagatttatacaatgaaaacatcatgaaaaataataggaaaaaactgagtagtcactgcatagaccaaggctgctgagactgtatttcttttttattaggtctgtttatttattaggtgtttttctttttgtttcttctctctttttttttttttttttttttttttttttttgagatggagtctcactctgtcgcccaggctggagtgtagtggcactatctcggctcactgcaacctttgcctcccaagttcacaccattctcctgcctcagcctcccgggtagctgggattacaggcatgcaccatcatgcccagttaattttgtatttttagtagagacggggtttctccatgttgaggctggtctcgaactcctgacctcaggtgatccgcccgactcggcctctcaaagtgctgggattacaggattgagccaccgcacccggccgacaattccattcttatttccgtagaatgctttcaaagatgtttgagagaatgggaggaaaaggaaacatatctaaaatgccgatattaactgtaaataccaccccgccacacacacggattaaattctttttctactgacattctgtgttggtaacaccatattggtttctgtataaagatttagaaatgcttcaaatccaatgggtggagacagggcgttccctatggattatccactgattgcattatcactccctctataaaagaggagctagatgcagaagccactgcattttccggcaagccaagggctgtctgtgcctcaggagtggggtcagcaggaggaactctacagctatgggagaacctgcgttcacctcttttccaagcctgcctgttctggtgagtatgggatccttattgactattgaccaaaataatgtccatttgtattcctttttctttctgtaaaacatcttcacagtttagcaagttgttctcaaaactagatgctatctcgtggaaacttataccctaggtgttaatatttgttgagtaatactcaagtaatattcaaaatattcaacaatattctaattttttgttcacggagctatctggggataatagccctgattttttaaaagtccaacaacatcactaagaaggaaaagaggtattacttggccttgcagtcttcaaattgtctctctctctggaaagttcttgaaccagaaattgcttggtccctttaaaaaaaaattttagttctctggttaaatatcatgattggttagtccttccctaaactcactgtcatgattcattgtagtgaatttctttcttttctgtttctctgtttctcctccctccatccctctctgtctctcccttcttcttcatcatggaacttaattatatctgataccctatcggaaatttgtttttagtgtgtttattatgtcttccttctcaccaagatgaaaatcaacagagtggtgatttctgcagtttacttctggatcaggggttctactgcacagcttggcacatcataagtgccctgtaactaaggagactaaataattttccctccaaaggggaacaccttgggtcgtgtaaggggtagtattaatcttaatgccaggacaacagaaatgaaatgagaaggacagaaatgaaggctttatgtttgtatctgaaacagctttatgagactagagtcttccaattgatttagagcaagaaaggatttcaaatcttaggaggggcttaatcatctttctcagtatgtcatcaaaagattctctcatggtgtaactctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctaggttccaccccagacttacttgggttcaggtccacatatctgacttcagcaaaccctgcaggtgctgaggatgtacactgccatttgagacacatttccccagaaagagaggctggtgggaagattccactgagctgagagaagccccccacagctgatcttctcctgtctccatttggttgaaatttcacattttcttttcttttgaaaggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggcaacaggtgtaaggagtggatgtttttgtggtgagaaattgggttttatgggatgaggaaggagacctttacatgtcactgtacatctcagtttctgtttaccatgattttaattaattgtttttgtttgtttgtttgtttgtttgttttgagacggagtcttgctctgttgcccaggctggagtgcaatggcgcgctctcggctcactgcaacctccacctcccgggttcaagtgattctcctgcctcagcttcccgagtagctgggattacaggtgcccaccaccatgcccggatattttttgcatttttagtagagatggggtttcaccaggctggccaggctggtcttgaactgctgacctcagcaatctgcccacctcggccttccaaagtactgggattacaggcataagccaccttgcccggctgttaattagtttttgtattaaattctaatttaatctttggcctggcgctgtggcttatgcctgtagtcccagcactttgggaggcggagcagggcagatcgtctgaggtcaggagttcaggaccagcctggccaatatggcgaaaccccatctctactaaaaataactaatcaggtgtgggggcggatgcctgtaatcccagctactggagaggctgaggcaagagaatcggttgaaccaaggaggcagaggttgcagtgagccaaaatggtgccactgtactccagccttggtgaaactttatctcaaaacaaaaattctaatttaattttcaaatgaaatcctttaaaaatgaaattctgtaattttaaatgaaacgaatacattacattataatttgttaaaaatgtattacattttcatttttaaattgagttttcattgtttgaaattttcgatttaggggtacatgtgtacatgtttgttacatggatatatcgcttaacggtgggggttggttttgtagtttatgggttacccaaatactaaacatcgtacccagtagctaagttttcaacccatgggtaaattcaattaacctagcctgaaggattattcagtgtttagacattacattttctccctataatatacattctcaaggcgaagttggtacgtatcccaagattttttttttaatgaaacatttttaccccatttactctgatgtggttatcagacattttgtgcctgtatcaaaatatctcacgtaccacataaatatatacacatactacgtccctgcccgctgtttgactttgagtttccttacctctttctctttatcgttgatcaaaacatggaatggaatacttcatggtaattattttatgcatctcgggttaggtggaaactactggttgttttcactctagcagagttagggtggcaggaagtgcctatcagcagatgctactgcacaccagcccgggcgacagagcaagactctgtgtctaaaaataaatatataatttatatataattataaatacattatatataatttatatataattataaatacattatatataatttctatataattataaatacattacacataatgtatacataattataaatacattatgtataatacaattatatactatataattatattatatactataatatatttcttatataattatattataatataatttatatgttatataattatattttatattataatataatttatatgctatataattatattatatattataatataatttatatgttatataattatattatatataatataatttatatgttatataattatattatatatataatataatttatatgttatataattatattatatatataatataatttatatgttatataattatattatatatataatataatttatatgttatataattatattatatattataatataatttatatattatatacttacatatattatatattaaaatataatttatatattatgtaattatatattatatattataattatatttatatatcatatttatataattatataatataattgtataatatatactatataggtatattatataattatatataattatatatattataattatataatataatatatattatattatataatatataattatacataactgtattaaatataataatatataattatatataatatatataatatactataatataattatatataattatattatatattatgtataatatataatttatattatatagtatatataatatatataatatataatatgtaatatataatatataatatatataatatgtaatatataatatataatatatataatataatataattatataaaattatatcatattgtattataattatatattatatataatatagttatgtataattatatattatataatataatatatattatattatataattaatatatataattatatataataattagatacctatatattatataattatattatataattaataaatatattacatataattatataaatataatatataaatataattataatacataatatatataattatataatatataaattatattttaatatatataattatataatatacaaattataatttaatatataatatgtataattatatactatataaattatattataatttataatataattatataacatataaattatattataatataaaatataattatataacatataaattatattataatatataatataattatataacatataaattgtattataatatataatataattatataacatataaattatattataatataaaatataattatataacatataaattatattataatataattatataagaaatatattacagtatataatataattatatagtatataattttattatacataatgtatttataattatgtataaattatatataatgtatttataattatatataaattatatatttatttttagacacagagtcttgctctgtcgcccgggctggtgtgcagtagcatctgctgatgggcacttcctgccaccctaactctgctagagtgaaaacaaccagtagtttccacctaacccgagatgcataaaataattaccatgaagtattccattccatgtttcgatcaatgataaagacgtaaggaaactcaaagtcaaacagcgggcagggacgtagtatgtgtatatatttatgtggtacgtgagatattttgatacaggcacaaaatgtctgataaccacatcagagttaatggggtaaaaatgtttcattaaaaaaaaaatcttgggatacgtaccaacttcgccttgagaatgtatactatagggagaaaatgtaatgtctaaacactgaataatccttcaggctaggttaattgagtttacccatgggttgaaaacttagctactgggtacgatattcagtatttgggtaacccataaactacaaaaccaacccccaccgttaagcgatatatccatgtaacaaacatgtacatgttcccctaattcgaaaatttcaaacaatgaaaactcaatttaaaaatgaaaatgtaatacatttttaacaaattataatgtaatgtattcgtttcatttaaaattacagaatttcatttcatttttaaaggatttcatttgaaaattaaattggaatttttgttttgagacaaagtttcaccaaggctggagtacagtggcaccattttggctcactgcaacctctgcctccttggttcaaccgattctcttgcctcagcctctccagtagctgggattacaggcatccgcccccacacctgattagttatttttagtagagatggggtttcgccatattggccaggctggtcctgaactcctgacctcagacgatctgccctgctccgcctcccaaagtgctgggactacaggcataagccacagcgccaggccaaagattaaattagaatttaatacaaaaactaattaacggccaggcaacgtggcttatgcctgtaatcccagtactttggaaggccgaggtgggcagattgctgaggtcagcagttcaagaccagcctggccagcatggtgaaaccccatctcaactaaaaatacaaaaaatatccgggcatggtggtgggcacctgtaatcccagctactcgggacgctgaggcaggagaatcacttgaacccgggaggtggaggttgcagtgagccgagatcgcgccattgcactccagcctgggcaacagagcaagactccgtctcaaaacaaacaaacaaacaaaaaaaacaattaattaaaatcatggtaaacagaaactgagatgtacagtgacatgtaaaggtctccttcctcatcccataaaacccaatttctcaccacaaaaccatccactccttacacctgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggctgcgcacacgctcagcaccagccctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtataactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccactcttgagatgcagacaacccttggcttgccggaaaatgcagtgacttctgcatctggttcccctttttatagagaaagcgagtgataatgcaatcagtggataatccacagggaacaccctgtctccgcccattggatttgaggcatttctaaatctttatacagaaaccaatgtggtgttacctacacagagtgttagtagagaaagaattgaatacgtgtgtatgtgtgtgtggcggggtggtatttacagttaatatcagcattttagatatgtttccctttttctcccagttttccaaacatctttgaatactttctatagaaataggaatggaattgtctatgtacataaatgttcacgtaatatttgatttaataacaacaactaaagaccatttaaatgttctttaagaaaagaaagcccaaaacttttattcacaatcctatagaatatatcacacagttgttgcaaagaaattactactttggccgggagaggtggcttacgcctataatcccagcactttgggagaccaaggcaggtagatcacctgaggtcaagagttcgagaccagcctggccaacatggtgaaaccccatttctactaaaaatacaaaacttaccctggtgtggtggcatgcacctgtaatcccagctactcgggaggctgaggcaggagaatcgcttgaacctgggagggagaggttgcggtgagccgagatcgcaccactgcagctcagcatgggcgacagagtgagactccatctcaaaaaaaaaaaaaaaaaaaagttctatttcgtgcatttacatttaatataattaccagtaaatttgaaattgtttcaatcatctcatttttcctaggttttgacttaactgactcacgttccttttgcctttacttgactgactttgaattaaatatgtttattattttattgttatctccatgaacttgctagttacagccatacaaatctgtgtagttatgctaataattaaatcatatactctgatacaattaattactttaacccctcccacaaaatgctaatactttagaacacttttaattctctttttagctgtttctgacttttgtattaccattctcatgcatattaattctacacatattttactctccaggagacatttctagtattgcttcataaagcaatatgcactaatatttacctacagcttatcttgtgcattcatctttgttcctttctgcatttctagcattcaatctgggattatttccctgtggacttgagaattcattctagtatttttcttctaattcaatgctgctaacaactaattgttttcctttacacttttatttaggcatctttatttgggggcaatattgctgtcaggtacgggtgtctggtttgacaaatttctttcagcatattagaaatggtgccccactgatgtctatctcattttacctgtgttgagatgtcagctgtcaggcttttccttgcttctttggtttccacattctctaaactctttctcgttgtggttggtttgtaggccacagtgtagctcattattgcttcctgtgtatttcctttgcctagagggtgtggagtcaattgcatctgtgggttgatgtctttcattggtttggaaggtgcatatgtatccttcacttctgatatccattcttgtccaagttctctctactcttcttttaatcacatcccacttgtctctgaagtttccaatgttgttcatgctttggtgggaatatttgctcttgaaccttgttccactttgctaatctaccttttttctaggttcagtctcattttaattttccttccttccttccttccttccttccttccttccttccttcctgtcttccttccttcctgtcttcctttcttttctctcttttctttcgagatggggtctcactctgtcacccaggctggagagcagtggcgggatctcagctcactgcaacctctgcctcccgggttcaatgattctcctgcttcagcctcccaagtagctgggactacaggcacatgccaccacacccagcttatttttgtattttttgtcgagacggggtttcaccatgttggccagggtggtctcgaactactgacctcaagtgattcacctgccttggcctctcaaagtgctaggattacaggcgtgagccaccgtgcctggcctaatttcttatactcttagtttcagttctaagcataaaacacagtaaatagctttaattaaaaactaggtagaagaacagcttcacagtcaatgaggagataatctgccttcttgatacaatgaaactctaaatagaaaggagaaaattcaaatttgaaccatattaagatacattaagagcaactattcattcaaatacatcagtaagagagaaagcgtggaaaaccggagtgggggaagaggtttggatcctgtacccccaggaaagtacatcaagccagagtatatatataaaaaaaatcttaatatttaaaaaaaagagaataatgtcaaacaaacagagaaaaataatgaaaacacacttgaaactgggtgaaaaacttgaatggatcctacacaaaagaatataaacaagtgaccgtaaaaaattattattatcattattattattataaattttcaggtggagtcttgttctgtcacccaggctggagtgcagtggcacgatcttggctcgccgcaactctgccttctgggttcaagcgagtctcctgcctcagcctcctgagtaggtgggattacaggctcccaccaccacgtccagctaatttttgtattttgagtagaaacagggttttaccgtgttgcccaggctggtcttgaactcctgacctcaagtgatccacctgccttggcctcccaaattgctgagattacaggcatgagctaccgcgcccggcctaaatgaccagcaaaatttgagcaaatgtttaacccttttagcttcagggaaatgctaaaaaaataaaaattacaatgagatactattatacagatatctatacattatattataatatataattatattataatattatataatataattatatataaattatatataatataattatataatatataaattatatataatatataatagaattatataatatataattatattctatatagaatataattatatataattatattctatatagaatataattatatataattatattctatatacaatataaaatataattataatatataatataattataatacataatataattatatattatatacttatagataatatataataatataattatataatatattattatataattatatatataatataattaatatataattatatattatataattaaatataattatattataaattataatataattatattatatataattatatatataattatattatatataattatatatataattatattaaatataattatatattataatatattatatataattatatatataatatattatatataattatatatataatatattatatattataatatattatatataattatattatagattataatccataattatatatattataatatatataattatatgatatattataatatattatattatatataattatatattataaataatatattatattatttataatatataatattatattataatatataattatatatattataatatataattatatatattataatatattatatataattatattatagattataattaaatatatttaaattatacattataatataattaaatatatttaattatattatacattataatataattaaatatatttaattatattataatgtataatacaattatataatataaattatattataatatataattatatattttacatttcatatataatacaatatattacatataatgatagttatatataatacattatatataaatataattatatacaatagaatatgttatatataattataattatatatattatagataataaatatattcattatgtatattatattttttatattatatatttactattattggaattataatttattttatgtaattgtatattatatattataattatatattatatgtataattacaatatataatatataaattatatattatatatgtagattacatgttatatataatatatgtaaattatatattatatttatatattatatgtaaattatatttttttcatatattataatatatgtaaattgtatattatatttatatattataatatatgtgaattgtatatatctatatattataatatatgtaaattgtatattatatttatatattataatatatgtaaattatatattatatgtgtaaattatatatatttatatgtataaattatatattatatttatatagtataatatgtgtaaattatatattatgcaagtatatatagcttatatatagtataattatacaattctatataatgtaattatatattaaatatatgtaatttatataatatataatgtgtatttaatttatattatataattacattatgtgtttatatatattattatagagagagataaacaagaatctccatgtgctccccaaactgtctctgggtttccatctgtgggatgcctttcccagtgtcctaaggatcttggagagctcccttctgtggctctctgcagggagacagactatccctaaatacaactgccagacacagaacaaaactgttgccgtcatgccaggtaccacgtcagtatcttcaaccaagattggagctcttctggggtgctacagaagcccacgggtaaggagtttgggaattctacagagaaatatttgggtctcccctaatgccactctcttacatctcatcgaatggaaaggtggacactgagcttacatatccatgagagttataacagagttataaacagaccttagggaattccctgtatcatgaaatgatcatgatggtgatgatgctgatgattattattattattttggaaagaaggtctcactctgtcaaccaggttggagtgcagtggtacaatcacggctcactgatgtctcgacctcctggctcaggtgatcctcccgcctcagcctcataaggaactgggactacagatgcatgccaccacacctagctaattttgttgttgttgagaaggggtctcacaatgttgcccaggctggagtgcagtggcatgtggtatgatcatggctcactgtagtcttaacctcctgagctcaggtgatcttcctgcctcagcctcccaaggaactgtgactacaggcgcatgccaccacacctggctaatttttgtattttgggtttttttggtagagatggggtctcactatgttgcccagcctggcctcaaactgttggccccaagtgatcctcccgccctggcctcccaaactgctgagattacatgtgtgtgcccagtcaacattattaacaatagcaaggatgggaataaaacagaacgtgcagtggatgctgtgagtctcgacccagagtcctgtccatggccaatgcctccatcccccagctgctgagaatactgactgctgacagttcatagctgtgtgccttactggaaacatcaggattacaggacgccaggaattccgcaacacagagaagtaccccatcctagaatatgactttctcaggggcatccagagaccaggctcacacctataatcccagcaatttgggaggccaaggcgggcagatcacctgaagtcgggagtttgagaccagcctgaccaacatagagaaatcccgtctctactaaaaatacaaaattagcgggcgtggtggtgcaggcctgtaatcccagctacttgggaggctgaggcaggagaatcgcttgaacccggaaggcggaggttgtggtgagctgagacggcgccattacaaacaaacaaaaaaccaaaacaaaacaaaaaaaccagagaccaatgactgtcagatgctagagatacaaagagaaaatttactaaagaatttacttctgcctttcacaccaaaagagagaaatctctggtttccaacacttcctcaagacagtgaaccctttccaatacacagaagacttttactttagtaaattctggattgaccttttttttttttttcctacttgctggatcgcaaggtggaagaattgtggagcttgcccatcaaattctgccactgcactccagcctgggtgacagaggagacttggtctcaaaaataaaaataaataataaatgtatacattttgatgggtttggacatatgcacacacttatggtgccaccaccacaatcgaggtactaaatatattcattcatgtcatgcccttttcaaagtacaaggaccaggtcaggagcagtggtggctcatgcctgtaatcccagcactttgggaggccaaggcaggaagattgcttgaggccaggagttcaaaaccagcctaggcaaaatagcaagagcctgtctccataaaaaagaaaagaaaaagaaaaaaatgaaaaattagctgggcatggtggcatacacctgtaatctcacctactcaggaggtcgaggtgagcagatcacttgaggctaggagttcaagaccagctggataacatagcaagaccctatgtctacaaaaatgttttaaattagccagatgtggtggtgtgcacctgtagtcctagctcttcaggaggctgaggcagaaggatcacttgagcccagaaattcgaggctacagtgagccatgatggagccactgcactccagcctgagcagcagagtgagagatcctgtctcaaaaatatatatattattactgttagtaaaattagaaattagatggtaaattaaactttctaacattaatttttataggttataaatttttataggtatgcatccatctctgtctagatattaaatctgatttattcggctgggtccactggctcacgcctgtaatcccagcactttgggaggccgacgcaggtggatcacctgaggtcagaagttcaagaccaacctgagcaacatggtaaaaccctgcctctttttaaaaaattaaaaaaaaaaaaagactacataatatgactatgtgttagtagatgagtgattaaataaattttggtacagcaattaattggaatatcataccacttatttaagacttggctaaacactcatatctacctggaaaaaagtccatggtctgttaattttttaaagtaatctccagaataattagtatatagtattatagtatttttaaaaactattttaaaactctcaatataggaatatatattgtgataaaatgctttttctagtatttatgtagtaaattatattattacatgtcttaagtttaattttttgtagagcaaggactatagtaatggtcacctcaaagtcaaattagagaagggaaagggagttttatcttattttttactttaatttttttttttgagatggagtttcactcttgttgcccagtctggagtgcaatggcgtgatctcggctcactgcaacctctgcctcccaggttcaagcaattctcctgcctgagcctcccgagtagctgagattacaggcaccacacccggctaatttgttttgtaattttagtagagacagggtttcatcatgttggccaggctggtttcgagctcctgacctcaagtgatccacccacctctgcctcccaaagtgctgtgattacaggcatgagccaccacacccgggaaagggagttttgaattgtgttttacatactccatatttgtgagaatgagcatatattattttattaattttaaaaatctaattaaaaacttttaaataaaacaacattaagaactatgaaatgtaggggccaaccccacagggtcagtgggtttttctccctgtgtgtggagacaagagattgtagaaataaagacaaagagataaaagaaaagacagctgggactgggggaccactaccaccaagatgcagagactggtagaggccctgaatgccaggctgtgctgatatttattggatataagaaaaaggagcagggtaaggagtgtgagccatctccaatgataggtaaggtcacgtgggtcacgtgtccactggacagggggcccttccctgcctggcagccgaggcagagagagagagggagagagagagacagtttacgccattatttctgcatatcggagacttttagtactttcactaattttgccactgctatctagaaggcagagccaggtgtacaggatggaacatgaaagaggaccaggagtgtgaccactgaagcacagcatcacagggagaccgttaggcctccagataactgcaggcgagcctgattgatgtcaggccctccacaagaggtggaggagtagagtcttctctaaactcccctggggaaagggagactcccttgccccgtctgctaagtagcgggtgttcttccttgatactgacactaccgctagaccaaggtccgcttggcaacaggcgtcttcccagccgctggcgttaccgctagaccaaggaggcctctagtggccctgtccgggtataacagaaggctcgcactcgtcttctggtcacttcttactatgtcccctcagctcctatctctgtatggcctggtttttcctaggttatgattgtagagttaggattattataatattggaataaagagtaattgctacaaactaatgattaatgctattcacatataatcatatctatgatctgtatctagtataactattcttattttatatattttattatactggaacagctcatgccctcggtctcttgcctcggcacctggatggcttgttgcccacaatgaaatatgaaaaatttagcacacagatcaccatatgtttcctcatctataaatagtgatagatagtaacaccttccttataggtctctgtgaaaatatttagggataatgtatgtaaaactgtttattaccaggcaggttggaaagtaatgtcccattcatttgtccactaggatggccatagggtttttggttttttttccttttaattcttgaattccagagtcttcaaatacattccattgttgtaaagtgaatcatattcacattttttccctagagtttagcgattccttttgcatacaaattcaggctgtatgtgttcacacatagatctcaaataacatcttaattttcacaacgaaaagctcccttcctcaccctgtagcctggctcctagaagcaacttttttttttttctgatagtaattacatatttgtaagttaggtatttatactgctttttcatttatcagctttaaactatattgaattactttcttctccgaaacaattagcacataactcttacgtactgtaaaactaattttcctcaccaaacataatcatttaaggaatctggataaatcaaaattcaatgtttatcattttatgacatcaatatttaccatttgtagcatctaaaccttagccagacatgtaacaagtagtatgtcattaataattttttctcattttttcttttgatctcttaaattttaaaatttccttttttatttcttcctatgaatccaacacctattttctccaccagaaatgtagttctcttttcagtagatccagatgtgcactagacaattaatcagctttggctttcacttggagacatccctccctagtcctccctcccctcgtccccctctggatgggagaaatatgcatacatgatcccatttttgaaagaaattaggaagctcaaaatcacacaaaaaggctgggtgtggtgtggctcacacctgtaatctcagcactttgggaggccgaagtggggtatgacttgaggccatgagttctagaccatcctgggcaacacagacctcctctctacaaacaaatacaaaaatagtcaggcttggtagtgtgggaggcccgggtggaaggatggcttgagctcaggaggtcgaggctgcagtgagctatgattgcaccactgcactccagcctgggccacagagtgagaccctgtctcaaaacaaacaaacgaaaagccacacacacacacacacacacacacgccctaaatgtgtggctatatcattttaacaggcggtgaatgtggagaaatgactgaagaaaactttaaagagttcattttgcatcctgctacctgaacagttttaaaatccacaaaaagccctacacccaaaaactgacctccaccaagtcttgtcctctcagcctactagctcaaccccattccatgccccaccactgccttatcttgtccacatactcgcccaccaaacctggtattaacccacagcaagatccgcccatcaaacctaatgcccgcccacaacctcgccccggaacttagtctctgtcctgacagccccgcccccatgcctggtaccgcccacggtcccgccccagaacttctccccacccccggagctgatctccacccacactcagccctgcctccaggcctggtaccgcccacagccccgctccagagttggtccccgcccccggaactggtccccgtcaacactcaggcccgcctccaggcctggtaccgcccacagccccgctcaagagctagttccgcccccaaccctgccacagacccgcgccaggacgaccctgcctccgcggctgtccctagccagggcccaacctggttctattaataactaagcaaactagaacacctcagccggaggctggggtgcgcggctgctgcacctgcagcctgaacccgggggtcctgacacgccgcattttgggctgggaccagctggagccggaagcggaggtgcagtgtggctagccggagaccggaagcggaagcgcgcttgtgtcttgtgagaagagccgcgcttgcagcgtctgggagaatctttcggtctccgcgagaggtgcttcattccgtgagtccgagtccagagaggggccccagccgcgggcctgcgtccctcccgggagccgggtttccgcccctgaggcctcgggctgtgcgctcagttaagcccgaagctgctgtttcctccggtgtccgggccccgcgcccctgtcatcctcactctgtcgtcctcaccctgtcgccctcacccggggcgattctgcgccccaggggacttttggctatagttggagacggtttgggatgtcacaaaatggagggtaggagggactgtgctactactgtaatctagagggtggaggccagggatgctagcagctcagcatcctgcagcgcgtaaagcagccgccgccagcaaagactcatccagccccaaatgtcattagtgcccaggttgggaaaccctgctggagggcattaaaatctctgcagtcctgaatacactgtagaaattatttagaattcagccgagtccacttataaggcctaaagtgacgaatttaaagcatctggagtcaccatacaatctccagccaaatgagttaagcaagtcagatgaaaacagctttaagcttcttgtcccattttagggaccagatggctggataggaatctggtgaattcaggcacagccagtagcctgggttcttattctttaaatcaattttttttaagtgaatggggtggtctttctatgcaacaactgtattagtctcagtaaatacattttactatacgtacatattactccctacaaaaggcctcataagcgatttttgtgccctttttatttagacgaaaaaagtataattcaagctcagatttgtgttgaaaccagcctcaagtttcacctatcctcactgatccgtggacttctgtatgatcaggtaggtaccgtgtagaacctgcaagttgcaagactccactgtgtagaaaacctgtgaatggatttttcctgtgttcaggttgtaaacacaaggactcactaacagtgagggtatttttttttttttttttgagacagagtctcactccgttgcccagcctggagtgcagtggtgcgatctcagctcattgcaacatctgcctcccaggttcaagcagttctcctgcctcagcctcccaagtagctggaatgacaagggtgcaccaccacgcccagctaatttttgtatttttagtaaagatggggtgttgccatgttggccaggctggtctcgaactcctgacttcaggtgatccacccacctcggcctcctaaagtgctgggattacaggtgtgagccacgagtgagggtatcttaaaaattatttgtttgatgccttatattcaagagaaggatactaaggggtgtgtgataatgtgtgtcaaaataagtcagtaaatacagctatatgcaaatcagtacacaaaacatgtaaacactatttaaaagtttttttttcaaccttccaagacatctcaatttttcttttatttttttcttttcctaacaggcctgccagcctgtagacttatgctgtataataaggtagctgctggtccatgcggttgttttaatttaaatgtagaccaattaagattccataaaattttaaattcagcttctcagtcgcactaaccacatttcaagtgcttgacagcgacatgtggttaatgcccctattgaacagcaaagattaagatcatttccatcatcccagaaagccctgctgggcggcattgttctagtctcttcccatctgtccattgcaatgaagccagaacggctattgtaaaagataatttgtggccaggagcagtggctcaagcctgtctgtaatcccagaactttgggaggccgaggtaggtggatcacctgaggtcaggagttcaagaccagcctggccaacagggtgaaaccccgtctgtactaaaaatatataaattagctgggtgtggtgactctcttgagcctgggaggcggagactgcagtgagccaagatggcaccgctgcacttcagcctgggcaacagagcaagactgcatctcaaaaaaaaaaaaaaaaaaaaaaaaagctgggcatggtggctcacgcctgtaatcccagcacttcgggaggccaaggcaggcagatcacgaggtcaggagatcgagaccatcctggctaacgtggtgaaaccccgtctgtactaaaaatacaaaaaaaaaaaaaaagattacccgggcgtggtggcaggcgcctgtagtcccagctactcgggaggctgaggcaagggaatggcataaacccgggaggtggagcttgcagtgagccgagatcatgccagtgcactccagcctgggtgacagagcgagactccgtctcaaaaaaaaaaaaaaaaaaaaaaatacagccaggcacagtggctcacacctgtaatcccaccactttgggaggctgaggtgggcagatcgcctgaggtcaggagttcgagaccagcctggccaacatggcaaaacactgtctctactaaaaatacaaaaattagctgggcatggtggtgggcacctatgatcccagctactcgggaggctgaggcagacagaattgcttgaacccaggaggcggaggttgcagtgagccgagatctcaccattgtactccagcctgggtgacagagcaagactgtctcaaaataaatacataaagataaatttgctttagtcactcgcctgcctgaaaagcctttgctggctctccactgcctctcatgttcaaactcctcaccactctttataatacctttcaaaatacaacctttcccgtgcactctggccccttatttgtccacatgctccaaactgtgaacttggcttcctaagcagcttgctttcctgcctctgcacgtgcactttccactgagcaagaccctacctcgactctcaagactcaattcaaatgttcttagtgtttttccttccaaggcttcccagtccccttcttcccagatcctgggttggatgccatgtgcccctctgccatatcacatatcactctgaaatgcagcagcaggtctgtgtgtgtgtcctgctcccagaaagccagttcttagatgacagggatcttcctcccctccatctccagcacccagctgggggcaggtatcaataaaacgtgaatgaggggtcaacgtcgggaccctagggctgcagaagggatttgagaggaataactgggtgaggaaatgctatgcctggtttggacttgggagggaagagggggcgacccaccaggggctcacctgtgcagagttctcttctctaccgtttgtgcaacacagctgctggaagagcccactcacaaacaagtataaatacatggaactgtagagaaataatacagatatttgtttttttggttttttttgtttttttttttttgagatggagtcttactctcacccaggctagagtgcagtggcatgatctggtctcactgcaacctctgcctcctgggttcaagcgattctcctgcctcatcctcccaagtagctgggattacaggcacccaccaccatgcccagctaattttttaaatatatttttagtagagacaaggtttcaccaacttggccaggctgttcttgaactgctgacctcaggtgatccgcccacctcggcctcccaaagtgctgggattgcaggcgtgagccactgtgcctggctataatacagattttcttgcatgtcataatactaaaactttcaggcttttacatataagtacaaatatataaacttttcacatgtatatgtgaattttgggggttctgttaacaccacagagaccagatgtcagagacacttggcagctatattaactggagggtgggggctgtgaggctgcaggcaggaatgggaaagagcctcccatctctgcttggctccaagtaccagcgaacaactggcctgtggggaatggctctccattcagtcctctcccaatccttctctccccggagattgggggtatgggggtcacccaggataaattccctgggcaagagatctagaaggaagccagggcctgaatgctacatctcaatacaaattcctagagagactgagtggccctgccttccatgaatagccagcaccgtccaccctctacagctctgttttgtctacctggcccaaactcttacaagtctctaactgcagacagcgcctgcccccgcccccaccaacccctcccacacacacccttgaccactttttttttttttttccaaatggagtgttgctctgttgcccaggctggagtgcaatggtgcaatcccggctcactacaagctctgcctcccaggttcacgccattctcctgcctcagcctcccaaatagctgggattccaggtgtgtgccatcacgcccagctaattttttatttttatttttttagtagagatggggtttcaccatgttagccaggatcgtctcgatctcctgacctcgtgatccgcccgcctcggcctcccaaagtgctgggattatagacaggagccaccgcgcctggccagccgctttcatctttgtgtgtatatacacacacacacacacacacacacacagcccttcttttctcataaaaaaggaaacattccatatatgctatttggtacttttttttccccttaaatttactgacgataataacctctattgatatctagagatcttctctcttttttttttaatgggtgcactgtaatgccacagtgaataatcttacacaacttttacatttgtgtatcttacagatcgattcttagaagttgcaggaacctagggtctctgatagaaaatggctggagctctgctgggctggcatgagagtggggagtggggaggaggaaatcaactgaaatgaggggtagtgacatctgagctgggtgaggtggaaaccaggaggagggggtggtcaaggcagatcacaggctggagagggggtgaccgaggcagggcacgggctggaggggggtgaccgaggcagggcacggactggagggggggtgtgaccgaggcagggcacgggctggagagggggtgaccgaggcagggcacgggcaggagggggggtgaccgaggcagggcacgggcaggagacggggtgaccgaggcagggcacgggcaggagacggggtgaccgacgcagggcacgggctggagggggtgaccgaggcagagtgttccccccatttcttccagggtgctgtcctgagagcgctgcgggataaaggaggagcgtcctgcttcccggctgccctgttgctgtcggagtcacaggatggcggctgtcgtcctgcccccaactgccggtgagtcatggggtcctggcagttctcagagtccaggcttgaaaggtcctgacccacagcatgggatgggagggggttgggcagagcaggtgaggcaggagtggagccccaggggcccagaggtcctccgtgtctgatcgggcggctcttgggacttgggacttaggcatttgggtgtctgtggatgtcacctgtgtggtgaatgtgctggagcttttgaattctcccttcagttctttctgtgaacctgataaaaacacagtgacgccctcggaacttcagtttcctcatctgtgaagtgggaataatcccttccccaagtgcagtcagaccttaagccctgtttcctggcgtggatgcggcagggccatgctctggtttccttggattgctgtgggttggtgtttgcttggagtagaggtggatgctttgtgggtgactgtgtatgcatggggacctggtcgatcgcaggcaggtggggaagcctccagatgtgtgagtggacacagggcaggtgtggattcctggtactcatttctcctcctccagctctgtcttccctgttcccagcctctcagcgagaaggacacacagagggcggagagctggttaatgagctcctgaaaagctggctaaaggtgagtcggatgttcctttttccaaatcatgattccttcagccagaaggttggacttgatgcctttcagtggcctggagccccacggccaaacttgttcctcaggcatcccagggtctctgagtgagggctgcccagaaaatgtcagtgtgtgtcaacgtttactgcaggttcagagctccctccagagtccctgagtacatcatgtgctcctgagagttttaagggaaagccaagtaaagacgtgatgatgttctaaacccaagcaattaataaaggccatacggaaatcattcattcacttaccaagtatttctctgatttctgccatgtcacgggcccatgatcccctggagactgagggaaataagatcataggagctcccagtttgagtgagaaaagacagctgctctgcggtactgtgcgctggacctgggagtagcctaaggagacaagcattgagggctgagctcagaagccagggagaagagctcagaacctcaggagaggagctcagaatccccccacatctcgtgctcaggtttccccagccctggctctgttctcctggcccctcttcctgtgcacattggtgggggtggtccttggctaagccgtgatgtttgcaatgctttagggcttggtgacctttgaggatgtggccgtggagttcacccaggaggagtgggcattgctggaccctgcccaaaggacactgtacagggacgtgatgctggagaactgcaggaacctggcctcactgggtaagcctaatgtcattcctgcatttatttaatgactcaggaagtcagtcttttttttctttttttaaattgaggtaacacaggacacaaaagtcaccatttaaactattttaaagtgtccaatttggtggcttttcgtaggttcacagtgtagtacagccatcaccactaattccagaacatagttgtcacaccaaaaataagccccatagtcatgaaatggtctctccccagttctccctcctgaacatcttggcaggcactaatctttccgtctctatagatgtgtctcttctttttgagggggttgtttttagacagtgtctccctccgtcacccaggctatagtgcagtggcgtgatcctgagtagctgggaccacaggtgcggaccaccacgcccagctaatttgtttattttttgtagagacagggtcttgctatgttgccctggctggtctcaaactcttgggctcaggtgatcctcctgccttagcttcccaaagtgctgggattacagatgtgagctaccattcctggcccaattcttgacattttatataaatgaaatcatacaaaatgtggtcttttgtgtctcactttttgcttagcataatgttttctttctttttttttttttttttttttgagatggagtttcactctgttacccaggctggagtgcagtggtgtgatctcagcttactgcagcctccaccttccaggttcaatctgttctcctgcctcagcctcctcaacagctgggactaaaggcatgcgccaccacactcagcaaatttttgtgtttttaatagagatggggtttcaccatgttggccaggctggtcttgaactcctggcctcaagtgatccacccacctcagcctcccaaattgctgggattacagggatgagccaccacgcctggccgatgttttcaaagtacagctgtgttgtagcacatagcagaacttcattctttttatggttgaatattattccgttatgtgtatataccactttttatatatcatttcatcagctgatggaaatttagcctgttctcatcttttggctattgtgggtagtgctgctatgatcattcatatacaagattttgcttgagcacctgttttctcttgggtatatacctaggagtggaacttctgtgtcctgtggtaattctgtgtttaatgtgttgaggaatgtccaaacttttctacaactgctacaccattttacattcctaccagcagtgcatgagaccagcaacgtattagtttctctgcatccttaccaacatttgtctcttttcctttttttaaaaaattatgatagccattcttgtggttgtctgtctcattgtggtttttatttctattccctaaaaaaaatgatgagattggccatcttttcttgtgcttgttggccatttatacatcttttttgaagaaatgttcattcaagtgctttttccatttggggggcattgtttgccttttcgttattgagttgtaagagttctttatatgttctgcatcctagacctttatcaaatatatcattttcaaagatttcctcccattcagtggattgcctttttactatcttgaatgatagttttgcaggagatagaattcttggttgatatttttctttcagtacttggagtatgtcatcatcccactggcttgcggcctccatggtttctggtgacaaatcagctgttaatcttgtacatgatgacttatttctcccttgccatttttcaggatagtctgtctttggcttttgacagtttaatgttaaggtatctcagtatgagtttttaagtgtatcctattgggagatccttgagctgctttgatgtgtagacttgtaattttcatcaaatttgggaaagtttggccattatttttacatatattcctttttttttttttttcccggagtctcactctgtcgcccaggctggagtgcactggcacgatctcagctcactgcaacctctgcctcctgggttcaagcaattctccctgcctcagcctcctcagtagctaggattacaaacgcgcaccaccacagctagctaatttttgtatttttagtagagacagggtttcaccatgttggctaggctggtctcgaactcctgacctcaggtgatcctcccacctcggcttcccaaagtgctgtaattagagcgtgacccattgcaccttgccaatttttccatatattccttctgctcctttctctgtctcctctccagtagcaactcccattatgtgtattcagatgtttgatggtatcttctgggtttcttaggctctgttcatttttttccctttatttttaatttctgctctacagatcaggcaatcttaattgacctgtcatcaagttcactaattgtgtcttctgcctgatcaagtcttctgatgaacccctctagtacatttttcatttcagataatatatatttttcaattttaaaattcctatttggctcctttttataatttccatctctttatgattttctctatttggtgagaattcattctcatggtttccattagttctttgtacacagtttccattaactccttgagcatatttgaaatagttgatttgaagtcgttgcctaataaatccaatgactaggtttccttatggaaaatttctgttcatttcttttttcctataatgcagtttcattcattttttgtttctttttttttttttttttttgagatggagtctcactctgtcacccaggctggagtgcagtggtgcaatcttggctaactgcaagctctgcctcccaggttcacgccattctcctgcctcagcctcccgagtagctgggactacaggcgcccaccaccacgcctcgctaattttttatatatttagtagagacagggttcaccgtgttagccaggatgatctcgatctcctgaccttgtgatccgcccaccttggcctcccaaagtgctgggattacagccatgagccaccgcgcccggcccatttttttgtttctttacatgcctcataatttatttgctgaaaactactttcagaatattacaatatggcagttctttaaatctgatttcccccctccccaaggtttgttgtagttggtattgtttctttgtttagtgacatttctgaactaattttgtaacgtctgtattggtcatgtgtggccactgaagtctctgttctgttagcttagtgttcagcttgggattaatttgtcagagatttttttaaatacctggaacccaaaagatgaccagtctttgccaatggatctgaattacatgttggagcatgccttcaaaactcagctaaagcatcttacaactctgacttagccttcagttccttcttatgcagagcctgaaggtcagtcaaaggtgagggcttggtgccttctcagatcttctctgagcatgtgttcatccctgggtatgagcatggccttctagaaatgtgtggaggccgggcgcagtggctcatgcctgtaatcccagcactttgggaggctgaggtgggcggatcacctgaggtcaggagttggagaccagcctggccaagatggtgaaaccacatctttactaaaaatacaaaaaaatcagccaggcgtggtggcaaatgcttgtaatcccagctacttgggaggctgaggcaggagaattgcttgaacccaggaggtggaggttgcagtgagccgagatcacaccactgcactctagcctgggcgacagagcaagactccatcttgtgggggaaaagaaggtgtggaaagatgctctactcctcagagcatcttgttcccaacttctcctcccaggttttttggttagtcttttgtttgcttcacagttttcccttgccccattgagcagtggctgatttgcctttagatgtgttgggacacacttccctctccaccctccagcttccataggtgtagcctcttcagacctgggagagtttggagttacacaaataaagggaagccctttgatccagcccatcagggagccagcagacaggtcagaagagaacagccacaggtttttgagaataaggtgcattctgttcccttcagcactagaaacacaggttgttgtcctcaaggcaaaatggggaatagagtgtgcagctagagtcagttaaaatgtcacaaatctctcttacccagattcagctgtttgtcttgattaggcattctcctgtggctgtaaacttttgatgacattcaagagctccaatgaagttgattctgtgtttgcccatttacatactgtttttgtgaagggatggagttgtggagttccctactccactaccttcactgacattacttcgtttaagtccttcataagcacctctgttcctaggtctgtgctgggatgtgggagtagtgaagaatgcaacagacatgccccccaccctcatggagctgtctgtctaatgctatctgtatgaaatgaagatctccttctttccctgactatatattctctgtagttaaatcttttgggctttcagattctgtatttaaacctggacaggggctcctgggaccagttatcctgcaaccaccctagatattgcttgtggggtgtgtgtgtgtgtgtgtgtgtgtgtgtgtgtgtgtgtgtgtgtgtgtgtgagtgtttaagacggttgctatatttattcaattttggcataattatttctctgctcctgaagtcacacctcttcaccttcagaactgatttcagtttcatgggagagcttgtctgctgcacagtccccctacatcatgtgtcttttctccatgtacagggaaccaagttgataaacctaggctgatctcccagctggagcaagaagataaagtgatgacagaagagagaggaattctctcaggtacctgtccaggtgagcaccaggtggatataagtccttgtgaggaacagctctggccagggactgagaagttgggagtattataatacattaggaaatatcagtcagagaactgtgtaaatgccccttttcccaagaaggccaagaacgtttggtctgagccccctcatgtaccttcatgacttccaactttctgtcatctcatactttacttgggcctcaggggagaaaaaaagacatctctttttctgaaatttaagtctcctatgagctctttgatcagtttcagtccaccttgccttcctgacaattccttcattctgtcaacatcaatctcaatcttcctagagtctttcttaaacattgcctaaaattttcacacccatatctctttcaccgaatgccttctcaaaaaccctcacctctcagattctgccttcactcacgtatgcattttactatttcaccatcaacttaaaatttgcctcttttctatcaacttaaatttctttttaacttgtttcagatgtggagaatccatttaaagccaaagggttaactcctaagctgcatgtttttcgaaaagaacaatctagaaatatgaaaatggtaagactaacatgggtgattcctggtttttttcatggtagaatgccctacatgagaaaagccacaaggactggccttgttggccaggcacagtggctcatgcctttaatcccagcaccttgggaagctgaggcagttggatcatgaggtcaggtcaggagttggagaccagcctggccaatacggtgaaaccccatctctactaaaaatacaaaaaaaacttagctgggtgtggtgatgcgcacctgtaatcccaaatacttgggaagctgaaacagaagaatcacttgaaccctggaggtggagcttgcagtgagccgagattgtgccactgcactccagcctggcgacagagcaagactctgtctcaaaaaaaaaaaaaaaaaaagtggctttattaaatagttattaaaggaaagtgtcatttttttcaaagataaagtagtacctctggagagatactgtgaaattattttgaatttggagaaaagcattagttagccccaaacttgtttttcctgagaattcccacaagtaaatatttccagtagtctgagtcagatattggatatttgaaaaagaaattagccttaaatttatcaaaaatactctgtgaatatgataaagatttgtagaaagaatccatcttctttaaatgctaagaattcaaactgacagaagccatgtaccagcactcatgatggcaaaaacattaattccaatactatgatacacaacagaattcctgggagaggaaattcctctgacagcattcaatgttaaaaatattataaatggtacttattgtcatctcttaatcaataggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactctgtcacccagtctggagcgcagtggtgtgatcacagctcactgcagcctctacttcctgggatcaagtaattctcctgccccagcctccaatgtagctgggactacaggtgcatgacaccatgtctggctaatttgtttttttttaaactagagggagggttttgccatgttgcccagactagtctcaaactcctaggttcaagcagtcctttcatcttggcctccagaagtactgggattacaggcatgaaccaccatgcccagccaacttctaaactgatcaatatgggagtagcattcaatcacccacaggttaactcactctagagagaaatcttgtgagtgtaatctgtatggtaaaactttgagctcaaactttccccctaccaaaaaaaaagtatctactggggagctgcccaggtaatgcagtagctgtaggaaagccttcagtgatggcttcagggagtcacatgacaactcacaataaggggaaaccctgtgtgtggcatcaaaaatggaaaaccaggggacactcattccttaagtcacatttcggagatcatacaacagaggaatatgttgagtatacacagtgttgaaaagcctgtgacacaaacagtcatattaccaagcacaagacagtatagtttggtatgctataaaagccttgaatattctctccatttttaagaagtgagattcatactagaaaaaccattgaattccatcagtattagaatgtcatttttccacatttttaggaacctaactcagtgtaagataacaatttatacaatttattttttgagacagggtttcatctgtgcccaggctgtagtgcagtggtgcaatcttggcttattgtaacctctgcctcccaggcttaagggatcctcccacctcagcctcccaagtagctgggactgtaggcatgcaccaccatgcctgtctagtttttgtaaagatggggattcaccatgtttcccaggctgctctcaaactcctgggctcaagtgatccacctgcctcagcctcccaaaatgctgggaatacaggaacgagctaccactctcagccagaacttcttaagataaaggatgagggaatgttttcagtgatacctcttatattaggaaaaatatgtaaatgttccttggatgcaatactcacgagtgtattaatttcagaaaaattttcagtgattcctccctttatgcatgagagaattcatttagaggaagccctaggaacgtaatcaatgttaggatgcctcatctcttaactgagtggccacgcagtaacttagaacaaaaggtgtaagtgctatgaatgtggaattaccttcatcaatgtctcatttgtaggttgggccactagctcgttcattttcagtcttttaatataaacatttatggctatagtggtcctgaaaatcttactacctcgttttatatacagtgtatttattataattctaaaacatcaatacaccaaatattcagaaaggtatttccaaacagctcctgagtgatctagtttgttataatagaaattagacatttgccaggtgtggtggctcacacctataaacctagcattttgggaggctgaggcgggcagatcaccggaggtaaggagcttgagaccagcctggccaacatggtgaaaccccgcttctactaaaaaatacaaaaattagccgggtgtggtggcaggcatctataatcccagctactcaagaggctgaggaaggagaatcacttgaacccgggaaatggaggttgcagtgagccaagatcatgccacttcactccagcctgggcaaaagagtgcaactctgtctcaaaaaaaaaaaaatcagacaatatttgatatatttttttctaatttaatagtattttgccagagtacatggactttgtgattttggttgttttctctttgtgtcctaatatagcaaatactgtttctttttttttttttttttttttttgagacggagtcttgctctgttgtccaggctagaatgcagtggcgcgattgtggctcactgcaagctctgcctcccagattcacgccatcctcctgcctcagcctcccgagtagctgggactacaggtgcccatcaccatgcccggctaatttttcatatttttagtagaaatggggtttcactgtgttagccagtatggtctcaatctcctgacctcgtgatccacctgcctcggcctcccaaagcactgggattacaggcgtgagccaccatgcccggcacaaatactgtttcttaatgttcattctccctacttaaagaaaaagataagttgtcaatgagcagtattgaaaatgtacagtggggccaggcgccatggctcatgcctgtaatcccagcactttgggaggccgaggcaggcggaccacctgaggtcaggagttcaagactagcttggccaacgtggtgaaacctcgtctctactaaaaaaaatacaaaaattagctgggcgtgatgacaggtgcctgtaatcccagctacttgggaggctgaggcaggagaatcgcttgagcctgggaagcggaggttgcagtgagccgagattgcacaaccacactccagcttgggcgacagagtgagactccatctcaaaaaaagatgtacagtgtactaggctttcctgaagcttagacaggctttatcccactctgctggctaaaagaagtaggaataacgcactgggtgagacaccgtctggcttattctcatctattttcttttcattcttttggaaagtggacacaaagcatagagttaaaagagcttttttttttttttttttttttttcttcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtaatctcagctacttggaaggctgaggcaggagaattgcttcaaactgggcagaggttgcagtgagccaaggttgacccactgcactccagcctgggcaacaagagcaaaactccatctcaaaaaaaaaaaaaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaattctttctgtaattctgtcatttttactttatatatgtttatgtgtaatgtaactaggtgcgtagaggtttagatattctcctgtgaatttatttattttcagtaggggccataccttttcataccaaataattgtaatatgaaaatatattaacaaaaagagatcaaacatttcgctagcccatcctatagaccaggcgctcttcaaagtgccttataaatattaactgcgtcctcactataagcttgcaaactgtgctattactgtctccaacttacagatgggaaaactggcatggaaatgtctaggttgcttgcctgagttcaccagctagtaagtggtagagcacagattggaatccagacaggtgattctcataaccactagcctgttcattgagtacattccatgtggctaagcactgtttgagatgccatgtctagagcagtgaatgaaactcaagttttgccattgaggcacttacatcctaacggggaggggtgaattatagaaaaatcaacaacatggccgggcgctgtgactcacgcctgtaattccaatactttgggaggctggggcagatcatgaggtcaggagtttgagaccggcctgaccaacatggtgaaacgccatctctactaaaaatacaaaaaaattagctgggtgtggtggtgcgctcagctaatcaggaggctgaggcaggagaatcgcttcatcctgggaggtggaggttgcaatgagccgagatcgcgccactgcactccagcctgggcaacagagcaagactccatcgaaaaagaaaaatcaacaatattcatgttgtgcagaaaaataaagcattgtgagagagttacggagggctggggactttccattttatgtagcataggaaggaaaaggcccccagttaaggtgcatttgaggagagactattgagtaggaacttgtggcaagaggactgttggcatgcaaagacccacagcacagaggccagtatgactcaggtaaaatagggattcagggattagagggtaatcggagatgcagatcctgatcttgtggggttttataggtcattgttagggcttttccttacatgttcaggaagttggaatatcaagagtcccagcaggaaacagttgacacacacgtcaactgggatgattcaagcgcagtttatatcaaggggctcctcacagaattgtgaacaggatgtagggaaaccacaaaaggtacttgaaatggaacatcggtcttctccccacctcagatacgggtgcttctggttctccagccttcagactcagactcgcaacttacaccattggccctcctggttctcaagcctttggacttcacactggggtttacactgttggctcccctgttttcaggtctttgagcttggactggagcaagactaccagctttcttggttctccagcttccaaacaaatggcagatcgtaggacacccataagcctgaagggacaaaggaagagaactgcaagttgttgttcaagcgaggagagggctgcattccaggagctgacaggaggtcagtgaggggcaacatccagcctcgagttctgcaagaaatagtaagggtcggccaggcacagtggctcacacctataattctggcactttgggaggccgaggtgggtggatcacttgagatcaggagttcaagaccagcctggccaacatgatgaaacccattctctactgaaaatacaaaaactagccgggtgtggtggcatgcgcctgtagtcccagctattcaggaggctgaggcaggagaattgcttgaacccggtaggtggaggttgcaatgagccaagatcatgccattgcactccagcctgggtgacagagtgaaactccatccccacccccccaccaccaccaaaaaagagaaagaaatagccagggccagccctccttgtccttcattcttcttatatcatatttgggttccccatttgccaaactcaaccaaaagccaataaggtaagggagttcgttgatagcattcatagtaactaatcatcccaagtacagcagggtagaggaggtgaatctgctggggcgaatggaagatacccagtattggtcactccttttgcttctcagaatctactcatgcccatcacctggatggaaagttcatatccaagcccaggaattctatcagttgctcagctaccctggggtggtgtccatgcactgatactccccgatgaagcctaacatagttgccaacaccagtgtttcctgtataggatgaggaacagagccattggggaggaaagcaaaagaaataattaacctggccaggcgcagtggcttacccctgtaatcccagcactttgggaggccgaggtcggtggatcacgaggtcaggagtttgagaccagcctggccaacatggtgaaaccccgtctctactaaaaatacaaaattagccaggcacagtggtgggcgcctgtaatcccagctactcaggaggctgaggcaggagaatctcttgaacccgggaggcggagattgcagtgagccgagatcatgccactgcactctagcctgggtgacagagtaagacttcatctaaaaaaaaagaaaaaagagaagtaacctaaaggacttggttcccagagggaaacacttccaccaagagacacagtaagagtctcatcggatgttaaactgtgacttctatgagaccagcacacaaggaaagaagtcaccatactgacttaggtaattaatgctatcatccatagaatctgaggctgctgttacatgatgagtgcagggaggaaaacatttggcattcacggaatccattgggatgtctcttactattctttccccaattttaaagataaaaaaattttggccaggcgtggtgggtcacgcttgtaatcccagcactttgggaggccgaggtgggcacatcacaaggtcaggagatcgagaccagcctggctaacatggtgaaaccctgtctctacaaaaaatacaaaaaaattaactgggcgcgttggcaggcgcctgtagtcccagctacttgggaggctgacgcaggagaatggcgtgaacccaggaggcggagcttgcagtgagccgagatcgcgccactgcactccagcctgggcaacagagcgagactctgtctccaaaaaagaaaaagataaaaaaatttcaccagctatgtcctgagaagggcatggtgaagaccccgtaggcataaggatctggagcagctctccaggtaagccacctagaccagcaggatctaggtgagaaggaaatctagaattttcaccctagtcaagggtaaagggaatctggaaggtgcaagtaaaggagtgtgataagcatcaattgcatctctgagacttgttcaggtggaaagggctgtctacagtttgtcccactgatcttcctcttgtcagtttctccaggcaacgggaccaacctggatcctgagggcacttactttaagaatcctggggccgggcacagtggctcacgcctgtaatcccaacactttgggaggcagaggcgggcagatcacttgaggttaggagttcgagaccagcttagccaacatggtgaaacctcatttctactaaaaatacaaaaaatagctgagtatggtggcacatgcctatagtcccagctactccagaggctgaggcaggagaatcacttgaactcaggaggcagaggttgcagtgagccaagatggtaccactgcactccagcctgggcaacagagggagactctgtctcaaaaacaaaacaaacaaaatgaatgcagggcatctgagtggcacacatggtggaccacagtaggtacagtggtggcactacccagcaaaagagctcttcacccaatgtgctagaagccaatactatgacatcagatttttgagaaaaggaaaggtttgtattgcaagttaacaaggagacaggagtccagctcaaatttgtcttatgctgactttaaggcaataattttcttagaaaaggtgtagggcgtggattctgggattagcaggcgattggtgggaggaaaggtctgttaagtcctcaggcaggtgcaatgatctcttcatgcctccccatgggttccatgtgcaaagtcatactaactcaagggagtttgtatgaaacacgtggaaatttgcactgtgacatcagcaagctcattctgcacaaactccatttggccatgtgggttctcacagattttaggcagttttgttacaagtggaggcagtttcagcgttttagcaagttatttctttttttacctgccatcctgcaaactcaatgagaggtgaagccagctggacttcctgggtcgagtggggacttggagaactttcctgttttacaagaggattgtaaaacacaccaatcagcactctgtagctaggattgtaaaccgcaccagtgagcgctctgtagctagcaagaagattgtaaaatgcaccaatcaacagtctgtaaaacacaccaatcagcaagatcctgaaagcagccaattgcagggaggattgaaaaaagggcactctgataggacagaaacagaacatgggaggggtcaataagggaataaacgctggccactccagccagcagcggcaaccagctcgggtccccttccaagctgtggaagctttgttcttttgctcttcacagtaatccttgctaccgctcactctttgggtctgtgccatctttaagagtgaaggtctgtggcttctttcttgaagtcagcgagaccacgaacccaccagaaggaaccagcttccaacacatcaagaatttctgctagtctttgctttaacactttaggcatggtttcagtggcatatttcccagattcttcctttaagactaaggcactaaggccaggcgtggtgactcacgcctgtaatcccaacactttgggaggctgaggcaggtggatcacgaggtcaagagatcaagaccatcctggccaacatggtgcaaccccgtctctactaaaactacaaaaattagctgggcgtacctgtaatcccagcactttgggaggccaaggccggcggatcacgaggtcaggagatagagaccatcctggctaacacggtgaaaccccatctctactaaaaatacaaaaaattagccaggcatggtggcgggcacctgtagtcccagctactcgagaggctgaggcaggagagtggcgtgaacctggaaggcggagcttgcagtgagccgagatggcgccactgcactccagcctgggcgacaaagactccatctcaaaaaaaaaaaaaaaaattagctgggcgtggtggcgtgtgcctgtagtcccagctactcaggaggctgaggctggagaatcgcttgaacctgggaggcggaggttgcagtgagccaagatcttgccactgcacgccagcctggtgacaaagcaagactccatctagaaaaaagaaaagactaaggcactcccctagctgctggaggtgttgcctgatgatggtgatgctgctgtcctctctgggaactccccaaggcccagaggaaagtgcccaacccaagattatgctctctctccaggggttgcctacttccagtgactggttgatgtagggggtacaaaggtccagtgcctttgtttcaatgtaggacacccctgaagggcaaccccagcaccagaactccctgtgggatcgacggcagcctcagttgacaagttacatgtcagcctcatctgtcccctccgcttctcgcatgcctttaaagatgttgttcccaggagttttatccaataaacaaaaaattgccagcacaaaatctgttcccagaaaacctgatccgagataagatcactctatcagggtaaagaatccattcagggccggtctcaggagatcgagaccatcctggctaacacagtgaaaccctgtctgtactaaaaatacaaaaaattagccgggcgtggtggcgggcgcctgtagtcccagctactcaggaggctgaggcaggagaatggcgtgaacccgggaggcagagctttcagtgagccgagatcgcgccgctgcactccagcctgggcgacagagtgagactccatcccaaaaaaaaataaaaataaaaatccattcagataagggactggcagagagaaagcagaatgtggaatggatgtggaagaattaaattcagtcctgaagaccaggtcccaaagcaggaatagaagacagctatgctttgggtttgggttttttaaaaaatctttaattttttccgctttttccctggttccccaccaccaccatcaccattttatatgaagagtcctggttgtggccaaagcttaaggtttctgatgggaatacgaccaaatgacattatcccaacagtagcttcctttgtatctctttttttttttttttttttttgagatggagtctcactctgtcacacaggctggagtgcaatggtgccatctctgctcactacaacctccgcctcctggattcaagcgactctcctgcttcagcctcccgagtagctgggactacaggcacacgccagcacacccggctaatttttgtatttttagtagagatggggtttcactatgttggccaggctggtcttgaattcttgaccttgtgatccgcccacctcggcctcccaaagtgctaggattacaggcgggagccaccgcgcccggccccctttgtatcttatgtagggacatgaacttagcgccaagtgaaggacaagaattgatatccaaaatccaatagatttttcttttaaatacctgaaagtgaaactggcccaattttcccatattgctgatgtttatggtttccttgaataaacaaacaaattgatcttcccaatcttaaaacttaagaaagttacatttatcttatctgagttcctttctcaggaaaccaaccatcaggcctcccagatagtatctaggagctgaaacgcaccagaatactgcatttgtacagtgagacatcagacccatcacccatcatgattgcctaactgaccacctgcttcctgttgaccaactcctcttccttacccttccctaattcctgtattcccacacatggtaacatttcttccctgctatataaacctcaaattttagttggtcagggagatggatttgagattgttctcccacctcctcagctgcagcagctgattaaagccttcttccttggcaatactcattgtctcagcgataggctttctgtgcagtggtgagcagcaggacctagattgaacccctggtgtttcagcaacaacatagttcatcaccagcagaactgcacttcaagaaacactaaagaaagttttgggccagacacggtggctcacacctgtaatcccagcattttgggaggctgaggcaggtggatcacctgaggtcaggagttcgagacaaggctggccaacatggcaaaaccccatctctgctaaaactacaaaaaaaaaaaaaaattagctgggcgtagtggcggtcgcctataatcccagctacttgggaggctgaggcaggagaattgcttgaacccaggaggtggaggttgcagtgagctgagatcgcaccgttgctttccagcctgggcgatggagcgagactctgtctcaaaaaaaaaaaagaaggaaggagggagggagggaaggaaggaaggaaggaaggagaaggaaagaaagaaggaaagttttggggctggaggaaaattattccatgtggaagcaattccagaaatatataaggataatcaggaaagataaaatgtgagcaaatacaaataaatattgactgtataaatcaagcctgtatagttttaacacttttatacgtctaaatctttttttttttttcagacggagtctcactctgttgcccacactcacctcactgcaacttccgcctcctgggttcaagcaattctcttgcctcagcctccaagtagctgcaactacaggtgtgcaccaccacgcccagctaatttttgtatttttagtagagatggggtttcgccatggtgaccaggctggtctcaaactcctgacctcaagtgatccatctgccttggcctcccaaaagtgttaggattataggcgtgagccaacgtgcccagccctaattttttttttttttcaaataaaaagagttttaaatcacattgaactggtcccttaaaactagagataatagaaagcatggcaagccatttcccagtccccctaagactagagattatggaagccccagcaagtgattctcacaatctgcatacagcagtagagctgacagaagccctagcaggtaaccaccagtcaccctcaaaacaagaggcaacaggatgccagatctccacccctcaatcacttacaaacacaaaagatggagtccaaacatgaagacctccgtcatcgcgaaactactccagcaagcacccctcagtcacgtccaaaactataacagaagtccctgaaatgaccccttcagatgcccctcaacactaaagaatggggactccaagcccaatggcctacccagtctataccaacagtacaggcaagcggagacccagaatatgaccctccccaactagagataagtggaaccccatccaataatccctccatcctctccccaaacaatacacagtaaggcctctatctgataaatgctcttgacccttcaacactagaaaaaaatggaagccccaggcactggccctccagttacctccaacatcagagacaatgaaagcttcgccaagtgattccccgtatcgctcctacattaatgatggaaactccaaaaaccaatcaaccctcaatcctctacacactcaagaaaggaactccaggctgggtatggtggctcacgcctgtaatcccagcactttgggaggccaaggcgggtggatcacgagatcaggagttcgagaccagcctgaccaatatggtgaaaccgtctctactaaaaatacaaaaattagccgggcgtggtgacacgtgcctgtagtcctagctactcaggagactgaggcaggagaatctcttgaacccgggaggcagagtttgcagtgagccaagatcacaccactgcgctcaagcctgggagacagagcaagattctgtctcaaaaaaaaaaaaaaaaaaaaaaagaactccagcaaatgccaccattcttacccactaccgctgcaacatgcatcccttgtcttcccaagactataaataagtatccccagcaatgacacccaaaacaagcaatggtcagaatctcaacaggcagccccccagattctacaacataagtgacaaactcataccccagaaaactatctctcttcccattatcccaaagtaagagttaatagaagcatcagcaagcaacacccttaacataaacgaggaggggagcccagaatgcaaatcccgtctcccccaacatgagttgactgcccctgcggtgacccctcctttatcccaaacacaaggaataatcttagccccagcaggcaactcctgcagcctccccttgcaatatgagtatctctaccctcacaatatagattgatagagccctatcaagccaagtgtcccctgctaggggaatgttgggtactccagtctcagaacatggaagacgatggtagtcctgacaagctggcaaatactctaagctcccataatacaggaggtgatacagcccagcaagcaaaccttccaacatttcctgcacccagcagacccttatcagctgcattcccagttgactctcagagcatctcctgctcgctcactagaagcaaagaaagactagagttgggggtaaggctgagaggaagagagaggggagaagggtaaaagaaagagaagagggggaaaggagaccttccaagttgttctaaacccggccatgaattccagatgcctcaaacagctacaatcagatcaggcactccagcacaaaaaaagagattccgggctgatgaaaagaggtggtctgaaggaaaggtgggtgtgttgactagccttcagaatgctcaccaaagacccttgccacctgatattcctgtcctgtgtaccccacctccaatattgaatcatacacgacccatatgatcaatacagcactgttgcatgtgacatctgaggctaggtcataagacacactgaagcttcctccttggtctcttctattgctctttctctaggagaagccatccgccatgccatgaggagactcaagcagccccgtaaccagtaaccaactcaccagcaccacattgctagccaggggatgagccaccttagatcttccagccccaaattttgaactctaattaatgatatgtaagctatctgcaacctacttcaaaatgcatttaaaaagatgaattgatggatgatacagagatgtatatgacaaagtatagtaaaatgttactgatgaatgttcctgtacattttttcaaaaattatttccatgcttgaacattgctcataataatttgttagtattcaagaactcctacgaagcagtaagagaaagaccaagagttaattagagaaaggagcaaatgctaacaacagttcacagaaatacaagtggctctcctaagaaaaatgggaagtaatacattgagattccctttttcattgatcaggaatttttttcttttaaaaagataacagattgaccaggatgtggagacactggcacctccatatcataatgacgggaactcaattagtgcaactcccccggactaagacaaggacccaaccagacccagagccacgccgagcccagggtgccatggggagacgcggaaagagccgaactgaagcggcgaaatcggagaaaactgaagccgggcggagaaagccgaactgaacgaactgagccgaggagcggcggagaagccaaggctgggcgaggggagccaaagacgggtggtgggagccgaggtcggccgagaggaaccggaaaagccaaggccaatgggaggagccgaggccaggcgggaggagccgagcagggccgaaaagcagcgggaagggcggcggagaagccgagccatggccaggacggagggaggggaagtttcaggtcggagacagagagggacaggcagcgccatggtaggacgccaggcgaggacggatggggaagccgaagctgggcggaaagagccgaagccaggcgcgaaggaagccgaagctgggcgggggaagccgaggctcggcggaagagccgaggccgggcgggaggatccgagctggaccgaaaagcggtggcactggcgccaagcgcgggaggtcgcggggcagagagggcgaagggagggtagcacctggggtgagggcgggcgggagagtcgagctgggcagaaagagcggaagccgagagcaagtgcggggttgagggcgggcgaaccgaggcagggccctggaagccgaggtccagcgggtggcggagagggtaaccgaggctgcgtgggaggagccgaggtcgggtgggagaagtcgaagccccggtcgaaggagctgatgccaagtgggaggagccagtgccgggtgggaggagctaagcgggcgaaaagcgctgaggttgagccgggacccatcttcttgggagcaggggaagggaggtcaggggactgcagtggggaaggggccgtggatggttgagcccgaagctgtcaacatggccagagtcatctgcagggcctcaaactgcctctgcaaaaattaataacagtgagaaaattatgacagtgaaagacacctgacccactccatctcgcctttaacctccaaactctcctcggtcattcctaggtgtgggccaagctaaccttgggagaaatttagttacagtttaaataacaatagcctttcctaaaactaaaccgccttataaaaataagagatcaccaagttatgattagagcagggcctgaattctgctcagatgtagacttcgttaaggattaccagcccttgctcaggtgatcacaagatttgtaacccttccaattactcctgtaaataacatcactattgtagaagctaagattggccttttgagatgtcatttaagacttttgggccaggcacagtggttcatgcctgtaatcccaccactttgggaggccgaggcgggtggatcacctgaggtcaggagtttgagactagcctggccaacatggtgaaaccccatctctactaaaaatacaaaattagccaggcatggtgatgcatgcctgtaatcccagctactcaggaggctgaggcacgagaatcgcttaaacctgggaggcggaggttgcagtgagccaagactgcgccactgcacttcagcctgggcaacagagcaagagactgttggggaccagcctcaacaccacccgtagggtactctaagtccggtggcgtcaaaggattgagaagagacaagttaaaggtggggagccaggggggccagatgcgaggtaggaggcggcaaaaggctcagagctctggtctccacactattgagtacaatcacttagatctgagaagcagatgttcagggcaaaacagtgaaagggaggcagtgcgtcatacgcgtaatctatagcaatagtggtttaaatgattctccgttgtgctcaaacaacatatctttaacttatcggagagtagctagtgggagcaggctttactaggagcctgcacgtctgtccacattccagtgtttcaaaggagtgtctttctccttgaacacagtgtttacagataagagagcaggtctcgctctgagcatgtgaacatgatggcaattaggaggctttcctcctcagaagccttttgtggctttccacaacttattgtcccatatttttatggccagtttatacaggcaccccacaagcccttttcccaacagagactctgtctaaataaataaataaataaataaataaataaataaataaataaagacttttgcatttctgacgaccggatgattcctgtggcccccacccagaaacaaactcagcacacaaggactgtttatttccacgcatcctggaccaattaacagcacctgttccctgcctccctgcccacgaaactatctttaaaaaaccctagcctccaaattttcaggttccccatttagccggccgtgcattttgtttgtttgtttgtattttctgagacggagtctcgctctgtcgcccaggctggagtgcagtggtgcaatctcggctcactgccagctccgcctcccggcttcatgacattctcctgcctcagcctcccgagtagctgggattacaggcgcccaccaccaagcccggctaattttttgtatttttagtagagacagggtttcgccgtgttagccaggatggtctcgatctcctgacctcatgatccgcccgcctcggcctcccaaagttctgggattacaggcgtgagccactgtgcccggccaatgtgcatgttttgaattctttctctattccaattctcctgccttgataaatcagctctatattgatgagtaagatgaacttctccggtggtttcaggtcctcctgccctcccggtcctgttgctccggccctgccaccgtcccctgcgagggctgctccatcggcaacagctgcatgttctctgcccccagtgaatgctcattggtgatatttgcatagggacaccccatcggcctgacagacagtttctctgaactgcgctgagacctggcccctcacctgtttatcctcacattggaattctgttttggtgtttgctttttggaggacttgcatgataacactgttttacgaatgaggaaactgaaacacgaaggcacagaggggttaagtaacttacctaaggttacgcagctggtaagggatttaaatgggatagtctcactgcagaatcagtacccttaaccatcgcgctatgagcgaaagagacaatgagagaaccaaatcaagataaaaaagaacatccttatcttgattttgtggtctccctgaactttttttttttttaatttgagacagagtttctctcttgttgtctaggctggagtgcagtggcgccatctcagctcactgcaacctccacctcctggattcaagcgattctcctgcctcagccttccaagtagctggggttacaggcaagcgccaccatgcctggctaatttttgtattttttagtagagacagggtttcaacatgttggccaggatggtctcgaactcgtgacctcaggtgatccacctgcctcaccctcccaaagtgctgggattataggcatgagccaccgtgcctagcctccctggcctctttcaatgaggagtttctaatactttcatccgtttttcccacggctgacacatctagagtgccgttctttttttatttcaaaatatgccctgaagatggcagtattgcaccaccctaaatccacaagctcttttccaaatgtttgccctgatgtccatcttctgaaaacaataatcaccaattagacatgtgagccaattagcattaactccttccatgaagaacaatgcaattgtctcctagagagcaactatacaatttattcactttgttttttgtttgttttgagatggagtcgtggtctgtcgcccaggctggagtgcagtggcgtgatctcagctcactgcagtctccacctccccggttcaaacaactctcctgcctcaggcccccttagtagctgggattacaggcatgtgccaccacgcccagctcttttttttttttttttttttgtatttttagtagagatggagtttctccatgttggtcaggctgatctcaaactcccgacctcaggtgatccgcccacctcggcctcccaaagtgttgggattacaggcatgagccaccgcgcccggccacaaatttttgtatttttagtagagatggggtttcaccatgttggccaggagggtctcaaacccctgacctcaggtgatccacacgcctcggcctcccaaagtgctgggattacaggcgtgagccaccgagcgtggccgtaaccaggctcaatgactttaactcttttcctcaatgattttcattcctcaatggctttaacctcttccaaatgattgcgctgatggctaacatatgtctgtcttctgaaaacaataatcaccaattaaacatgtgagccaattagcatttactccttccattaagaacaatacattggtctcctagaatgcaatttacaattactcactttgaacaagggaaatctcttcaactccacagacaagggagccactccctttctgatcacagattacagtgagcaatggaagtttcataatcgatggccttcactttcttctctggaatgtaaagttgactcagctgggaagaagcccataagaaaaaaagatcaatatgagacaaggagacttgtctgcagtatggcaggctaattatcttgaaaaacagtcctactacacaacatttaaaaagatgaatacacacctgtaatcccagcactttgggaggccaaggtgggctgatcacttgaggtcagcagtttgagaccagcctggccaacatggcaaaaccctgtctctgctaaaaattaaacaaaattagccgggcttggtggcacatgccagtagtcccagctactcgggaggctgaggcaggagaatcgcttgaacccaggaggcagagattgcaatgagccgagatcgtgccactgcactccaacctgggcaacaagggcgagactccatctcaaaaacaaaaaaagaatacaaggccgggtgcggtggctcatgcctgtaatcccagcactttgggaggccaaggcgggcagatcacctgaggtcgggagttcgagaccagcctgcccatcatggagaaaccttgtctctattgaaaataaaaaattagccgggcatggtggcacatgcctgtaatcccacctacttgggaggctgaggcaggagaatcacttgaacccaggaggcggaggtttcagtgagctgagattgctccattgcactccagcctgggcaacaagagcgaaactctatctcaaaagcaaacaaacaaaaatactccccagaaaaaccctatttccaaataaggccacattctgaggtcctggggactaagagttcaatatattggggttgcacagttgaattcatctcattgtttaggcacggggaccaacctgtcataccccatcaaccatcaaatgcggctgctctctgggaagggggaataaccttggacaaaatagctcccttaagcctgggaaagttccagaagagggactcagttgtccgcccccagaagacaactttcctggaagttggaagagtgagcacttggttctgaagaggtgatctgggtggtgcatgacagcatccacgacagtggatgtgccgtggctcttgctgcatccactacagcatccactacagcatccgctacctccacctcaatatccactacctccactacagcatccactacctccactacagcatctgctacctccactacagcatcatggatccaccacagcaatcaccacatccactacagcatccactacagaatccactacagtgactccaacacagtggcctcccactcctggggttatgcttcaggaaatgggtcagcaacctctaaggagcctggagatcaacagttgagaacattagaccatggactcatagtctaaaccacccaccaactatgtcagccctattaaaattatggcttccctcttttgtgaagtactttgaagatgttttctctcacttgtgtactatcctgatgaccactgtctcatctgtggtcatgcagaacacacatggagcagagccaaggccagaatttgcatttcctggctcccaagtctgactgtctcagcaacccacatccccattctaacccagagcccagccagagttcctcctctggttgtgaggctgtggtctatgaaaccaaagcctgtgccttgctttctcagcctgtcagggtcttaccactggataggagccttggatgaaaggacaggcagacagataaattgatggacagacaagaagagggatagatgatggatggatggatgaatggatggatggatggataggtggatggataaatggatggatgggtggatgaatggacaggtaggtggatagatgatgaatggatagacaagatggatatacagacaaatgggtgggtggatggatagaaaggaaggaaagaaggacagatagatggatgggtggatgaagagaaggcaatagacaaacatataggaaattacaaatacagatagataaaaaaaaaaaaggccccaagagaagtagaggtagaaacagaatggtagaaaagggggaggaggtcagagatatgagtgggaggaggaaggtgaaatgagagaga

SEQ ID NO: 1225 - DNA, 289910 bp, Homo sapiens
tcactgaattgaaaatttttatagtttttattaaagccaatgagaaagagaaacagatgaatgaaaaactatgaattcaagacctcaactcatatcttagtgctccataaatgctttagtttatgagtcaaatagtgatattttaatttcaaggtgggatcttcaaaagctttataaatattattagctgtatagctgtaactgttatcattttagcacctaactcatacaattaacctttttttctttcaaatcatcagcatattaaaatactacagtgattggttgaattctattctcaatctgttttgagtaaatgtgctaatcttaaaagaaaaaaatgatactttgtatttcttatctttcagtaattaaaacaaataatctaatcgttacatttttgctacataatttgtttttttttttttaatttgaaaacttacccctaagggggaaaaatattcttgcttcaacctttttactaagacctagccttcaagagagaattataggaaataggccattaggtgttttgaagattgcttaatgcagcagttcccagggtcttatgctgagatagtaagtacccaggggtagtattatggggtgggagaaagcatagttcatggtaaaaataggtttggaatagccttaagttaaaaagagtactgtaggcttctcagagcctttaatgggcttgtgttcatgtcaaattctttagaaaaaaactggcttaaaagtactgatcaaaagaccatagaagataaaagaaaaaaaaacatggcagaaaccaacttgagtgatgcagtcagataaaatgaaaagcagaaatgaaatgacaaccttagcctgggtgtgtagctagagagacagaaggtgaaggtcaatttcactgcattacaaataaagcctatgtctgactttcagggaaattgctgttggctttatcaaatgtctcttggagtccacttccccctctaagtagagggacctagtctctttcctgccactgcatctccagtgcctagaacagtgtctgtcacagagaaaatgctaaaacattatttatcaaatagagtgaataataaataaatgacagttaaagcataataactaaaattatataatttggagacttcaatggatggcccacttgtacaaatgaagacttccaggtgtttcctaatcctgtctctatcctgagggattatacctaaggggttttccacaggaaaagtttgcacagccttggcaacctgccactgcacgtgaaggcacagtcaagagtggttatttgtgagaaaacaataagatttgaagagagtttgactgtcctttgcacagtatatttttgctcattaaataatgttaattttaagcttaaccctaaagcttggatttttatattgatattgcctcacatttataaaatagttttcagttctcttccaaattgattagctctatcagtcatgaataaaatgacaaaatagcccattgcataaagagggaaaaaaagcaaatcatgtgaatgattttcccaaggtcccagaattattttacagaagacccaagattagaaccaaggtcttccaacttctctattcatcgtaacacacagaagagtgaacatgaattccatctggtttgagaaatcccctgacttgcagtggaatggaaactttcttttaaaaataacctctatttaaaaagaagtctacatgactaattctcttaaaataataaaacaataataagaccacataaaagtcatctaaaaagcctggtgaagagaagatcaaagatgcttatgtaacgacaagatagaagccaagcttcagaattcaaagcttttgtgagctctaatcattttgcttgcattcataaaatcttaaacattttccctctattttttgatgtataatattcaatcaattgtaatggaatgtaagtggagagggctggtaatggctcctaagcatgaaagtgaaaccatggcccatgtgcagcgctgccgcccagaggggagaggcagccttttccttcgtatccggatccttttagaaaagagatatggcctgcgactgactggtgccacttttattccttttcttataagttaattgaaatagaagggctttgttttttccccttttccactctaaagtcaaaggcactgactaggttcactgctgggctatagatgtgtgtgttctttttcaatagaattgtacatttccttataaatatatgtaatatataatatatatgtaatagatattaaagggatgggggaccattctgtgacatcctgggcaatagcattttcccagtttattgagatttttgaattgcaagtgggattaaatcttcatgactgactcacttcttatgctactgcacaaaagctgagggagttgacatttaaactcatgtgattaaacaattcataagtcttttaaaactgtacattttgacatgaaaagaatgcaaaaatattcacaagctacttagctagtgaattaggagcttttaacagaaaaagaaaataaaagaaggctttttattttttcaaagaagtggttgtatacaaccactttctcaagttttctggtatgtatttatgagattaaatgtataaaagaatgtggtgtcttcaagcagttaaataacaagctcctgttgagaaaacatcttgtagcaacaaaagagcttttaattccaaatttaataaatggagggaggggagcttttgatggtaagaaatggaaaagacagaagaaagaacatttgagggatggtggagggtaaacaaaacagcactcagcctagaaggtattcattttctgtccttaatgtaaggaaaaccataaaaacatctgcagttgaagattcagaaaattttcacagagaacattgggtttttataaacaacaaaaagagtcacatcaaaatttccttccttgaaacatttatgtaacaggaattaggaataggaatcaaaatggttttgttgtgaatagttaaggcagagagtatctgcattttgtattactgagaagatcctgtagagagtatatcccttttgtcacaaaggagagattggttcatcatgtgccatcatgggttccaggactaggacatttaaataaaggcacatgcagaacaaggttagtgaatgaagaggacaagagcagacatccagtcagttaccacgatgatagaggatggtgattgccaccaaaagtcataacgaatgttttgcatgtcacttataatttcatatatatgtgtggtattccccagccaatattcagcttatcttggttaatctctttttgtgtcttttttaaagctcctaattgaaaatgtttttgtcaagatttgttaaagaaaaaagtattctatgaaacattatgtttattaaagaaaaatacatccagccaacattgttattttcatcctagcctgagtgaaaaatcacataagcatatcacttagaggatgatttttaaacagagtctattattatttgaatgacttcactccaatccaaagcacactgggaactgtaaaatgttacagacgctatttcatcataaaggcagtgtgttatgggggaaatcattcttagctgtatgggagaagacatgactcccgacccagccactcattgaccaactatgtcgcaatgggaaaatcacttataatctgatacttttcttatctgtaaaaaaagagaagagaattattctatatgctgggactaaagagaataatgagtgaaataaggcatatgactattattatttttgttattatcagcataaataaaactcatagcactttgtagtctacaagttactttcaattgctttattctatttaattctcacagcaactctctgaaacaggttttatggtctccatttttcagatgaggaaatggagtcaaagaggtcagcacctgtgtgatatgatcaggaaaataaagtgccaggactaaaattctgattttcagatgccctacatcatgacccactaccccaaatcatttcattataaatattctagtttcatactaccttacagagtcaacaagggatgttaggcattccacatctacctgaataattccagcaattggggtaccctttcctcctgaggaaacccatctgtatgtcactattctcattttttaaaagttctcctttctcttgatccaaaatccaactctttgtaacttctgcttatatttttctatttctgtcttctaagaatgtacaaaataaatgaaattccttttcaactgaatgacttttgagttactccaaacttttatctctcttctggaaactaatcctttctaaaatacttagaggatacacttgctagtctcctcatcacaatgattttttttttaactctggaaatatattagttgtcaaaggcatctttttgttgtgtccaatatagcgcttataatattgtgtttgattttatgttaatttatctatctctcctattaaattatgtgcttcttcaaggtggagaggggatcataatatttattttttatttgtttccctgagacctaatataaaccttggaacataaaaaacctttaatattgcatgttaaattagtacactaaaatattaattgaatttaaccctaagcagcatccccaaaattgatacttaattatagaaattcaatttatagagtgaaacaggccacagttcaacttgatcatttctttagtcaaggctatgatgtaataacgggctcttaatttgcagaaaggaggtagacactgtcctccaaagctaatggtagaatctaaaaagacttcacaagagaagtgacaggccattttatctggaattggaagaaaaattatgcttttatgtaaagcaaaagcagtaagagtttaattctacaaaatacattgggactatattatgtaaagttttggaaattggaaaaaaatggctaggactttacctgctagacaatagtgacaagcaaaaattgctaagcagacaagttatgtgatattaatgatttcaaatatgtccctgaagctgacaaacccattctaaatgtttttcagctttcccaaatcgagatgacgagcacctgaataagattattgacactctgaaaggggagcagaggtgaaagtcatggacatgacaaagagggaggggaagtggtgcttttggggtgctacatgaaggttaaggacatgcaccaaataatggaaggactttactccgttaatttattcatttaacaaatatttattaaatctttactacagatatggttcctgttcttatgcagcttacagtgtagtgcaggaaagggcacgatttaaaaggaataaaagtaaggtgggatcagttgtaaattgggccagcttcacaggcactcggccagtacagtcacacaaggccgtatgctcagaagagccaagctcttggagtttaatgttctgcagtcattgtcttgaaatgtttaatacttttatctttaaatctgtgttttataattaccatccaatgagacaatggagcttgtgttggaggtttgaagcttcagctttcatgcagttctggctttcccttcctctcccacctctccaggaaggttcttagctgcctgctctctgcatcctggtgtcccaggccctgtctggccttccccttcctgccccaaccactgccaccctccaagtaagtggcaataggtctcagtagcagaaggagtcctgtcctctgccattgcctccagagggtgcctgggcatgagcacaaggacagttgagtggatgcacacctaatggcatcttgaaggcatgggggtgctggtgggagcagcgggaatccgtgcctcagagggcagtgccctggcaaattcggtaggtgacttggtgggtgcctcacatctaccctctagcaagcatgtcccagaagggggattgtaatttcctgggggtttcttatccactgtgtatggagacggtggcccatggaagggaagattgatttcccctgtgacagtcagggcttgaattcttgttttgcacaaggatctgcagacaatatagcaggccctgattataaaacagctgaagttagggacagtctataagtacctaacccggtagggagtgtggaggcctcatagtttccccagacatttaatctgagactatatctaagaactggtaagagttatccaggcagaaaggaggatgaagaaagttccagaaagaaataacatatgaaggcccagggttgaatcggagcccagaaagtgttccaggaactaagagaagttgagtgtgatgggaatggaaatggtgagcaacatggaggcaaatggcaagtcacggttagagcggaggtcagcagctctgccatacaacaaaagggcttgggaagatagctggaggagtagcaaaattaaagagtgttgtctcccagtgtttgctgtgtttaggatccatcttacctaccctgtgcctgtagagtccatttttgacatttaaataatggttgttacagtattttctgtaatatgtcatgtggctggaatgagcccatcatcctcccattgtcgaacttagatcctggatccttgtcacctatgaatgtgatgaaaagtgccctttttcctcagatttctgcaagctgcatattttgaagaaaagtgctcatcatgaaatcaaacaatcacaagtttatcttgtgcttcatcgccagcctctactgagagaaatactgtagttatttcacccaaactctccctgggagattgtgttatgcaaaagctaagtgaatggacctcaagagtgtaccaaaaaaatgtctccaagttgcaacaaagcatatttttcagaactgacataaagtcgatttttttccttagtaaggattgtttttatcacattgacatttagtttattagagctaactttataagaccagttcctaaagagctttttacctaaatctgttgccattttctatagataagatgagaaaatgctgaaaaagtatggtttttccctcaaagattattcaaaataaaatcacatcatcagttctttaccaccaggaagcggcataattacctcagactttcaaggaaacaggtatgcccagcaattggtttaatttaggcttagaattgttttcttcatccaaattgctagttcatcttctctatccttgatatactttttaatggaaaagaatctatttctattattgacttgtaagagtataattgaaaaataattagcaaggcttttacaaatgaatgcaggaaagagaaaagatatatatatatatatatatatatatatatatatatatatatatatatatatatatgtatgtatgtatatacttcaaaagtagtttccaataaatgccactagtctggtatccaataaatgccacaaaaaattagaaaagagaactaacttttgtggcacttttaacatgcaccagacaagttagatatgattattccaacttaatattcacagcatcccaatgttacccaaaagaaaatgagacagaaagggttcaataaacttgccccatctcacatgagatttactgatagagccaagccttaaattcaagtgtatcttatcgtaaattccttgtctcttctgtctcatgttaaaacattgaaaactaaactggagtagaattctgtgattgaagtataatttgcaataagaaagtcatgttatttatttagtcaataagaaagactttaaatcaatgtatttttgccttagtgtaataattattggatgcatagtgcttaactagctttatcagtatctataatatgatttgtttaaatcatgtctttaacttttgttttaagttcagggctacacgtgcaggtttgttacataggtaaattgcatgtcatgggagtttggtgtacagattattttgtcacccaggtaataagcatagtgtctgataggtagtttttgttgttgttgttgttttgttttgttttattttgttattgagatggaatctcactttgttgccaggctggaatgtagtggtgcgatctcggctcactgcaacctccgcctcccgggttcaagcgattctcctgcctcagcctcccgagcagctggtagtacaggtgtgtgctaccatgaccagctaatttttgtatttttagtagagatggggtttcaccatgttggcaaggatgatctcgatctcttgacctcgtgatctgcctgccttggcctcccaaagtgctgggattacaggcgtgagccaccgcgcccagatgatacgtagttttttttatctttaattttctcccaccttccaccctcagtaggccccagtagctgttgttccctcctttgggttcacatgtactcgtgtttagctcccacttataagtgaaaacatgtagtatttggttttctgctcctgtgttactttgcttaggataatgacctccagctccatgcatgttgctgcaaatgacatgatctcattttttatggctacatagcattctatagtggatatgtaccacattttctttatcaagtctaccaccgatggtcaattaggtagattttatgtcattgctatttgaatagtgctgcaatgaacatatgcatgcatgtgtctttagggtagaaagatttatattcttttgtgtatatatccaataatggcatgctgggtcaaatggtaattctgttttgaattccttaagaaatcaccaactgttttccacaatggctgaactaatttacattctcatcagtagtgcataaacattcccttttcttcactacctcaccagcatctgttatttgttaactttttaataatagccattctgactggtgtgagatggtatctcattgtggctttgatttgcatttctctaatgattattgatgctgaacattttttcatatgcttgttggctgcagatacgtcttttaaaaagaggctgttcgtgtccttagccaactttttcatggggttatttattgcttgttaatttgtttaagttccttatagattctggatattagatctttgtcagatgcacagtttgcaaaatatcttcttctgttctgtaggttatctgtttactctcttgatagtttcttttgctgtgcagaaactggttagttaaattaggtcctatgtgtcaacttttgtttttgttaccattgcttttggtgtcttcatcatgaagtctttgtcagggcctatgtccagaatggcacttcctaggttatcttccagagtttttatagttttaagttttacatttaagtctttaatctatgatgagttgacttttgtatatggtataaggaagggattccgttttaatctcctgcatattgctagccagttatgacagcgccatttattaacgagaaagtcctttgcccattgcttgcttttgtcacctttgaggaaaatcagatggttgtaggtgtgtggcattatttctgggtactctattctgttctattagtctatatgcctgtcgttgtaccagtaccatgtggttttggttactgtagctgtgtagtatgatttgaagatgggtaacttgatgcctccagctttgttctttttgcttaggattaccttggctacttgggctcttttttgcttccaagtgaattttaaaatagttcttttctaattctgtgaagaatgtcattggtattttgataaagaatagcattgaatctgtaatttgctttgggcagtatggccattttaaccatattaattcttcctagccacgagcatggaaagtttttccatttgttgtggcatctctgatttctttgagcagtgttttgtaattctcattgtagaactctttcaccttcctggttagctgtatttttagatattttattcttttggtggctattgtgaataagattgcattcttgatttggttgtcagcttggatgttgttggtgtataggaatgctggcaattgttgtacattgatttgtatcctgaaactttgctgaagttgtttatcagatcacggaacttttgggcagagactatggggttttctaggtatagaatcatataacctgcaaacagagatagtttgacttcctctcttcctatttaaatgacttttatctcttcctcttacctggtttctctgcctaggacttccaattctatgttggataggagtggtgtgagttttgtcttgtgctagttttcaaggggaaagcttccagccttttccattcagtatgatgttggccactggtttatcatagatgacacttactgttttgaggtatattccttcaatgcctagtttgttgagggttttttacgtaaagggatgttggattttattgaaagccttttctgcatctatggagatgatcatgtggtttttgctttttgttctctttatgtgatgaatcacatctattgttttgtgtatgatgaaccaaccttgcatcccagtataaagcctactttattgtgatggattagctttttgatgtgttgctggatttggtttgctagtttttgttgaggatttttgcgtctatgttcatcaaagatactggcctgaagctttctttttttattgtgtctgtgccaggttttggaaacaggatgatgctggcctcatagaatgagttaggaaggagtgcctcctcctgaatttttggaatagtttcagtaagaatgataccacctcttctttatacattgggagaattcagctgtgaatttgtctggttctggactttttctagttggtatgctttttattactgattcaatttcagaactgattattgatctctttagggattcaatttcttcctggttcaatggaggtcatatatttccaagaatttaatcatttgttctagattttctagcttgtgtgcatagaggtgtccatagtagcctctgacttttttttgtaactctgtggggttggttacaatatctcttttatcatttttgattgtgtttatttggatcttttcttatttttttcatatcagtttaactaatgatctatcagtcttatttattccatgcaacaaccaactcctgaattcattgatcttttgtatgttttttcacatcttgttttttgagctttttgttttgttttgttttgtttttagttgtcctttgattttggttatatcttatcttctactcgctttggggttggtttgctcttctttctctagttccactaggtatgatgttaggttgtagatttgagatttttctaacttttaatgtgggcagttagcactataaacttctgtcttaacactttcttaactgtgtcctagagattttgttatgttgtatctttgttctcgttagtttcaaagaatttcttcatttctgccttaatttcattgctaacccaaaagtcattcaagagcaagttgtttaattcgcatgtgatttcatagttttgagcaattttcttactgttgatttctatttttattgtgttgtgatctgagagtgtggtgagtataattttttttgaatttgctaaggattgttttatggccaattgtggggtcaattttagagtatgtggcctgtgcagatgaaaagaatgtatattctgtggttttaggtggagagttttgtagatgtttttaagtccatttggtcaagtgttgtgttcaggtcataaatatccttgtaagttttctgtcttgataatatgtctaatactgtaagtagagtgtttaagtcttctactatattatatggttatctaagtctctttgtaggtctctaagaactttctttaggaatctgggtgctcctatactggatgcatatatatttaggatagttaggtcttcttgcaaatcgaaccctttaccattatgtaataccctttaatttttaaaatatctttgttggcttaaagtctgtttggcttaaaatctattttgtctgaaattagtatactaatccttgctttcttctgttttccatttgcctggtagatttttcttcatccctttactttgagcctatgggtgtcattgcatgtgagatggggtctcttgaaggtagcataccattgggtcttgcttctttatctaactcaccactctgccttttgattggagcatttagcccatttatattcaaggttaatattgatatgtgtaaatttcattccttcatcatgttgttagttggttactatgcagacttaattgcatggttgctttacagtgttaatagtctatgtacttaagtgtgttttcaaagtggctggtaatggtctttcctttccatatttagcactctgttcaggacctctcataaggcagttctggtggtaatgaattcccttagcatttgcttgtctgaaaaggaccttatttctcctttgtttatgaagcttagtttagctggatatgaaattctgggtaggagtttctcttctttaggaatgctgaatcaaggccctcagtgtcttctggtttgtagggcttttgctgaaaggtccgtggttagactgatggggttcccttggaaggtgtccttccccttctccctagctgactttgggaatctgtttactatgtgtcttggagatggtcatcttctgtagtaccttgaaggggttctttgcatttcctgaatttgaatgttgccctctctagtgaggttggggaaattctcatggaccatatcctgaaatatgcttccaagttacttgctttctctccttctctttcataagtgccaataagtcatagatttggccactttacataatcccgtattgcttagaaatattgcttattctttaatcttcttactttatttttgtccagctacgttattttggaaaactggtcttcaagctctgacattctttccccaccttggtcaaccatatccatgcagaactatggtaaagattacataccaaaaatcagaacaatttccatttaccgaatgctgaccatcatattatgctcgacattcatgaatatcctctgttgtggaaagcaatagtgcagtttgaaaaaaaaaatcaatgctgctacctgagggaaaggcaagtgagatggactttgaaagggaaaagagaaagtgaacccaaaggtccaaggtcaagtataccctccaacagatcagagaaaagatgaaaatacagaatgagtaaggttgtgtgaaatttaatgaagaaagaaagcaaaattgcagtagcaatagtatcacaagaataacccataagtgtgagtgtacctgcattcaccctgagatgcacaccaaacccaaacttcccttctcccaactaaataatcacaagttctttatctgcctccaattagatgctgaaggatagagaaaaaagcaaagaaaagtctaaagttcaaaacataatgcacaaaacattttatgactgcttactacttgctgtatcctggtgataaagagaagcagtagaaagaaaatcacactaggaaaagagatctgagagttgaaaggcagcttcccagaatcaagccaagtatatgttttcatgttatttgtgttgcatgcttccactttaagtcataggtacttgcatgtcaaaggtactctgtaagcactaagtgaatcaaacagaatgaaaggggagagggaagatgagattcatttagaagaagaaataagaaggcaatttacttttgcataggtgggaacatagttcagggctctttacactggctaaaaaggaagaaaaataataaagagagaagggttgccaatcacacaaatgtaaatgttcaaagatatatgagatttgaggtggaagatgtatgatcgtatgtgtgatttcctcagtgacaggaaatatcagatttatgaatatactatgctccattttcatctgtaagaggaatttgaaaaggaaatattattttgggtcatgacttgtcttctgcatataataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagattctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgtttttaaaaatgaaaataaaaatctcagtgcaaagaatacatttacttctctagtagactattaattgcagaatcgcaatacatatgatctccttcttctttgttaaccaagtctcaatcacatttggttaacaaataaaatactacactccccgtcatcccttgtagcgaaatgagcttataagtctaagtcctgcccagtgagatgtaagcttactattttgtgacagtctttctgggaaggctgcttaaagggagccaataagtcaaggagaaaggataatcgtttatccttccccacctcttcctgctacaacagaagggatggctggagctatagcagccaatttagactatagataaactcaaagaaggaagctccatgctaaaaatggaatataggaagaaatagactgtatcaccgataacgtcctcgtgccaccagaatgatttatcttcaaacttctcttttaactgaaaaaaaaagtaaacttctgttttgattaagccactctcattttcattattatttccttccctggttatacacatttaaagcttattccaactgatttagtacttggaagtaagtttcttcaagtatcagaaactaaaatgtggcactaaatgtgtaatggaagcagagctgcataggtgcatagcaatgactcagataatgaaagccaaaaatctcatgatctttataataaatctacaaaatatttagtcaagtcatcacctgctacacattggaagccaaccacatgctgccaaaggctacatatagtattaggagaaatggtaaaatattggtatgggttgtcagaaaaatcctagcatgacaaattcgaggtggaactaactacctggccagtctcagagttgaaacggaaagacatgcacctttgctaaggaaggtactctttgcctgtaacccacaatctcagttgactgagagtctggtaatttgaaaactttcatggttgaaaaagccaactgcctataccccaaattgaaacagttaaaagaagcgtctgaaaattctaggcttagcgataaatatgacttttgccacaccatacaaaagttgtgagcctgctggcaaagataatgcattacttcatatgttctcaatgcagcagacagcaagctgaaaattatttagatgcacagagcacagaggtctgtaaataaaagaccagggtcttcaagcttaataattccatttacccaaggtcattgactgtttattcacacttggagatgaccaaaaaacaactacgctgaaagtctgtcatactttttagggtatcttattgtccaaaactaatccagtgggtcatgaacccgtactaaaaggaagtggcttgctacatatgtgcagtccttagtgaagatattctcctgaatgtccatttcagatgtggccacagaggacaacagaaaaggaagaccctcctgaagagcaaatccaggggccacgaaagaaaatgaacaagagaatttttattgaagagcagaacctgggactgccagatggaccaactaaagaactcacttcacaactagggcagtgagtcctcaccatttcttctcagcaagagttggctgctgtaaaatcagagagattattcatgccttatggttaataaaagtatctataggtaactgaaccttgaggagccaaattgaggcctgatgaaggagactgtacatcatccagagagaatgaacttggagcaggatgcaaagactgcaggggagaaatcagggtttttctgctggaggaagaagcagagggtacatagacataaggtatccaaagaagcccactatagaagctgggacagattgcatacttattctcaattcttcactcctccctatgcagtagagcagagaaaatcgagtatacctgtgacttgctttgaccagtggaaagttagaggggacaagagcacaggctttaaacatgcccatatgggacttctgtgcctaccatgagaacatgccccataattgttaatgcagggagaatgaggagatgtggtgcagactcttagccaatcccaagagctgggttcaagggtagccaacactcatcctagagaagtgtcccctctgacctgcagacacatggccaagaaaaatcaatgcatgttgttgtaaaccattgcatttcaaggctgtttgtgatgcagcatcctggctaataaaccagccaggtctattctaacaattgtagctcagagtaaagaatgtgggcatctcatcagcagacatgatcactaaaaagacagagaaaagatacaatgagaaaactataagcaaactcttggaaatccaacgaacaaaatagaagaaagaagaaagattaagaaatttctagaaacatcctacagtggtcgggaagactgagatattaagcctaggagataaaaatggacaggcagattcatatcatgcttaaaaagaaactgcaaatgattgagaagttttttttaaagtggaactatttcaaaagtaagaaattagtaaagggacaaagttgttaatgcaccataaacaagtgatcaaaagcagaaaaaaaaatgaactgctgtggaaatggacacagtgtgatcctatttttagtggactacttgagttttttaaaaaattaggaggaaggtaaaaggttcagaaaatagaaacagaagtgtaaataatactatgaaatgggcctagctgaaacagctcacttttcaaaagaatacattaaatgaagaatacagaatgagatccttaaaaaaagaagtcaggaaagtattacatagagtaactgcaaaggccttctctccttataacacggaaattgatgtatttgagaataagggtattaaaaaagatctttaagagtctacaggaaatagaagagctaggacaaagcatggatgtcatgtagaatattttatgataaactgctgacctgagccaataattcttgggctggggaaaaaaactgtttctctatagataggtgggtgggggtgagggtggggagggaaaattgtaatgcttactttctaaatagatttcaaaggaatgcgggagaacacaaagagaactagcttgcattgttttttttaatattagcattttgttgataaaacagaaagcaggaagaaaaataatgaatcatgcatatagtaataaaaaagtgtggtaggtgattaacgtgttaagagtcaagggaagaactcatcagaagagtaaaagaagagaactgaaaagcaaagggggacaatcaacaaaatgtgaacatacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtgcaatactgagcgctactccttgaaggtgaacaacatagaaatattgttcagtgcaactcaacaaatgtttatttaacgactgcaatgtactgagcaaattttaggctctggtaagacacatcagtaatgaagacaaacatatgcattaactatatcaagcaggacaaagggctctaaagagaatgaatgcagttctccaaacagagatctctgctgtcactattgaatatcttgtaaactctccagaaacgtgtatgtgcaagcatgtgtctgtttgtgcatatatatatatgtgtatattttaatgctacacatttgaagataccttattacactattcatgactttgtgattttctcttaacacagcaatttggagattaccccctttcagaacatagagagagctacttcatttctcccaatagcatattttattgcatggttgtgccataatttattgaattactggcctttaatgaacaattatgccatttccagtcctttcttattcatgtaatgcttattcatactgtgctttacatatgggctaatatacctgttaacacaaatcttgagaagtgaaatttctgtcacccggcaagtgaatttttaattttgatacatagtgccaaatagccttcaaagtgaaacattcacttatattcccaccaacagtgcacaaaattgcttttgtcctcaaacttcctgccaatgccatttattatcaaaccatttgatccttgcaagtacagtaactaagaagctatctcattgctgtttgaattacaaactacaaatctcattgtagtttaaaatacaaaccataatggtcttattatgagcaaatatgagtaggtttttacatatttaaaactcttttgagtttctcttactgtgaattatctgtctataatcttggcctatttttaaaaattaataagttagaagaaatgagccaattttcatatatcttggcaggtttttccagtttcttattttccattcaaatttatttatggttgttttaaaccattttgacattttgatctttttttaattttgagattattgtagatttatttgcagttttaagaaataatacagagagaattccatatacctttcaccattttccctcactggtaacgttttgcataactacaggacaatgtcacaagtaggaagttgacactgacacaatgcatctaccttattcagatgtcagatttacattcacttgtgtgtgtgtgttagttctacacaatgttgtcacagtgcaatttcctgtgtgcactactgtggtcgagatacagacttgtgtttcatcgcaaggattcccttgctacccttttctattcacagtccctccttaagccctgacaagcacacatctgttctccatctctataacttggtcacttcaaaaatgaatggaatcatggagtctgaatggaatcatggagtatgcaatattctgagattggctttttccactcagtgtaattgtcctgcatttgtaaaaaaattggcatttcgaattttggtactatgctatttagcttaaggttcataccaaactttaattgtagatttaaactttttcattgtctttcgtttggtagtttcatgcagttttccctaaagtggaccttgtataattttaataaaattactcttgcttgcttttagttttaatttgtttacctatattttgcttcctgcctttattgattttagatgaatatcataatagcacctgtgtcattttgtggtccaaattggtggtcttttaatgagcaattttatctcattgatatttactgatatggcaattagctgtggcattttatttcaagttctactttctgtatttaatgccatttatttttgctatattgtctatatttcttgtatttgcatgttttacttttataatttggaaagcatattctcttcttcagattttctggtagtaacataatatacacataatatacacatataaatatatatgtatacatttaaagaaaggacatgagaaatgcacatacaattctgcaaaagaacaaatagaaaaaaggtaagaacacatcaaaatatttagtcgtaaaagacatgaaaattataagaaaacccttctctgagaattcaaagaaattttttaaaaagtcttctgatacatatatatgtatatatgtatgtgtatatatgtacacatatgtgtatatatgtgtatacatacatgcatatatgtatgtgtatatacatgtgtgagtatatatacatgtatgtagtatatatacatgcatatatatgtatgtgtatatatacacatatctatgtatatatgtatatgtatatgcatgtatatatgtacatatatatacacatatatatgtatcagaagactttaaaaaattttctttgaattctcagagaagggttttcttattttcatgtcttttatgactaaatatttttgatgcgttcttaccttttttctatttgttcttttgcagaattgtatctgcatttctcatgtgctttctttctgtttgtctttgttatttttgttgtttttccccaggccaactatgcattagaggataatgttagaaagcacatcagtggagtgagttagatattcaggtagcttgcattcaaatttgtgtcttgaaatgtttcccaacaaaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccaccttctctgacattcttttctgcccagcaaggttagtgatgccccagactctgacacagcagctaagcgcttgctgttccaaagtggccctgatgacatttcagaaagtgtaacttacctttggataattctgcgtgctttctgtgaacatggaggcacacacctcctgctgctttcctcattttaactagatttaaatttcataacacttttacagccctccaggttttcatttctgcttctttgttctctgttttggttttaagttggtttcaaagaacggggcagaaatgtctttactctgccatctttaattggttcctgtactctttaatacattttaaaattaaagccagagaaagaataattaaacttccatgctgcaacccatagaagttccaatttcttgtgtatacagactctctctctctgcatttttaagaagttccatacacttttaggaagacttactgtcttctccaccaacctgagacacgtacccctacaagggtacatgaaattccactcaacattctgtgagttcacaccaaagattcataaggctacacattgttccttctatcattttctaaaaggattttcttctcatattttcttgtatggttataaataacatgttcctgttcacagtttgtatttagaacatttgctaggcattttgttttcaatcataatccttagagccttgaaacaaacaaatcacatatactgtatagaatgatatctgcttggtatttctgccttaggaaataatgttcatttttgaggcttcattttaatgtacagcagaatttagtgatatcacaatcccctacacagttctagtaaaactaaatgaaacagtgtgaagctcctagctttatctgaactcccatgtctgaaatctgtcatttgttggtgtttagtttgcctggaatgtttgtttacctactgcctgttgactagcttccaaatcctcttgatgagttgatttcataacagctgaaaataacattgcattcctcacctgtaacaggtggtccccaagtggctgtccatcttcccttgtgttctctgctgtgaactgtaaatcatgtcaagaaacgacaacccattagatgacatgatctaccatcactgcgaggagccacccgtcacaacatgcacacactttatccatcctatgcgcaaataataaatttggtcaaaagattgccatttcatgttctggaaaacatgaacttatgtgagcttatacataaaatattttaatctataatctcatgtatatgtcattatgtcatatttcccagaattcagctgccaaaaataacattaaagaagtagttcatgtcaggtaagatgagaatgccccataaatactgattctgaacctctagcagccatacatatgttaattcattattccacaaatattttgtgcacatattctgtgccaaacactgtgctaggtccgaagaataccaaaattaatcattacaaactcagagtccaaagaaaaaggcagactcacaaataaacagctgtaaaaatgtgtgttgctctatttggaggtattacgtagacattagggagagagcatctgtattagtccattttcacactgctgataaagacatatccgagactgggcaatttacaaaagaaagaggtttattggactcacagtgccacgtggctgaggaggcctcaccatcatggcagaaggtaaaaggcaaggagaagcaagtcacatcttaacatgaatagcggcaggcaaaagagcttgtgcggggaacctccaccttataaagccatcagatcttgggagacttattcactatcacgataatagcacaggaaagtcctgcccccatgattcaattacctaccaccaggtccctcccacaacttgtgggaattcaagataagatttgggtggggacacagccaaaccacatcattctgccccagcccctcccaaatcttatgtcctcacatttaaaaaccagtcatgccttcccaatggtccccctaagtcttaactcatttcagcattaactcaaaagtccacagtccaaagtctcgttcgagacaaggcaagttccttccacctatgagcctgtgaaatcaaaagcaggttagttacttcctagatacagcagtggtacaagcattgggtaaatacagccattccaatagggagaaattggccaaaacaaaagggctacggaccccatgcaaatctgaaacccagcaggacagtcaaatcttaaagctccaaaatgatctcctttgatcccatgtcttgcatccaggtcaggctgatgcaagatgtgggttcccatggtcttgggcagctctgcccctgaggctgtgcaggatgcagcctcccctccctgctggctgctttcatgggctgccattgagtgtttgtggcttttcctggtccacagtgcaagctgtcagtggatctcccactctggggtctggaggatggtggccctcttctcatagctccacgaggtggtgccccagtagggactctgtgtgggggctccaaccccacatttactttctgcattgccctagtagaggttttccatgagaggcctgcccctgcagcaaacttttgcctggacatccaggcatttccatatagcctctgaaatctaggcagaggttcccaaaccccaattcttaacgtctgtgcaccaccaggctcaacatcaggtaaaagctgccaaggcttgaggcttgcaccctctgcagccatggcctgagctctacattgacacctttcagccatggctggagcagctgggatgcaagacaccaagtccctaggctgcacacagcatggagaccccagattcgacccactaaaccatttttccttctagacctcctggcctgtgatgggaggggctgctgtgaagacctctgacatgccctggagacagtttccccattgtcttagagattaacatttggctacttgttacacaaatttctgcagctggcttggatttctcctcagaaaatgggattttcttttctatcacattgtcaggctgcaaattttccaaacttttattctctacttcccttataaaactgaatgcctttaacaacacccaagtcacctcttgaatgctttgctgcttaaaaattttttctaccagatatcctaaatcatctctagcaagttcaaagttccacaaatctctagggcagcaacaaaatgctgccagtctctttgctaaaacataacaagaatcacctttgctccagttcccaacaagttcatttccatctgagaccaactcagcctggactttattgtccatatcattatcagcattttggtcaaagccattcaagaagtctctaggaagtttcaaactttcccacattttcctgtcttctgagtcctccaaacggttccatccaatctcttcctgttacccagttccaaagtcacttccacatttttgggtatcttttcagcagtgccacacttcccataccaattcactgtattagcccattttcacactgctgataaagacacacctgagactcagcaatttgcaaaagaaagaggtattggacttacagttgaacatggctggggaggcctcataatcatggcagaaggtgaaaggcaagaaggagcaagtcacaatcttacatggagggggtcaggcaaaaaaagcttgtgcagggaaactccaccttataaagccatcagatcttgtgagacttattcactatcctaaaaacagcatgagaaagccctgcccccatgattcagttacctaccaccaggtcactcccacaacatctgggaattcaagatgagatttgtgtgagaacacagccaaaccctatcagcttcattctggggtcaggtggtagggacaacacaaacaccaagataagttcctttggagatatggcatgagctgaggcttataggatgaataagaagtatgcttggtaaaagagttcaggcaggaaggcattggggagtggcatttcttggtaaaggagttcaggcaggaacacattggggagtggcatttattgtataggggaaggagcaaaggtatagagttgagaaggaggttagaacacgcaaggaactacgagcaatactacaggagtttacttagtgatgctggggccagtgagatatgtggagcagtaagcaaaaggcaaggttgaggagcactccaggaacagtacgtaggaagccaggctggatcctgtggtcaggagcttctgaagagcttgctgttgtggatatttgcttgcacttaaataacttttgtattagtctgttttcacactactgataaagacacacccaacactgggtaatttataaagaaaaagaggttgaatggactcacaggtccacatggctgtggggggcctcacaatcatggtggaaggtgaaagccatgtcttacatggtggcaggcaagagaggatgagcgccaagcaaaaggagaaaccccctataaaaccatcagatttcatgagactttttcactaccatatgaacagtatgggggacaccgcccccatgattcaattatctcccaccaggtccctcccacaatacatgggaattatgggagctaaaattcaagatgatatttgggtggggacacagacaaattatataagctttattgaggtttaatttacatcttaagattcacttaggtgaacaattcaatgattactattaaattgacagagttgtacaatccttaacacaatacaggttttagaatatttccatcattccagaatatccctcatagccatttatagtcactactgactcctacctccaagaaccaggcaaatgctcatctgctttctatgtctatagatttgtcatttctggacatttcacataaatggaatcatagaatatgtagtcatttgcatctggtttgtttcatcaggcatcaggtttttttagatttacccacgctgcagtatgtatccatagcatatttgtttgtattgtaaaatagtattccatggtatggatataacatcattggcttatcttttcaccaattgatgggcgttcagattgtttctattttttggttaatatgactaatgctgccacaagcattcacatgcaagtctttacacagacatgttttcatttctcttgggtagatatttagggatagaattcttgggtcatatggtaaatttatgcttatctgcttaagaaattgtcaagctattgtgaaaagcagctgcatgattttacaatcccatcaacaatgtctagggttctagtttctcctaaggagttttaacgagacggataatatggctagatttgtgctttaggtaaatcaatctgatagctactaaaaatgagactgaaaataatgagcctgtttaggaagatgttacaataatctaggtgagatctctactacgattcccaactagaccattggaggagaagattatctcagaagaagaacaatgctgctgaataagaacaggtgatttgcttccatcagttgctcagccttgggaacgtgacttaccgtggtgtgaggacaaagcaggtacctgcccgccagccagattagctgaggaaaatacacttcaggtatgtaagcttatgccttcacatctgaaatgtcctgtactaacatatacaccctcaaactttccaacacttatactatcactgtgtcattttttcctggttcaccaactgcatactggacacagtgctgcacatgctattgggtatttttcctactttagagattatgttcatttggttctaaggataattgcaagaatattgttgtgctataagtaaataaatgctatgtatttataaattatgtgttaaaattatactatttctattgttagcacacacagtattaagtcatgtggcccaaatctcatatttcatagcatattatggttttattaggatacagtaaattaatatttcagtgagaaagtatttggaagtacccataagccttatcaacagctcatcccaatgtttcccttcaaacagccacgtggaatttgtgtaaatgagtctaaatgaatgataaggacaatatgatgtttgagttaaaatatcttttgaaactgaaaatgagcagctagccaaaaaaaatctgtcactttaaaaagatcaggaaaaagtcttaattctgccattgtgcaatgtatagcatgtaactaagaacaatatctaaggacaacaaatataaatattgaaggaagttgagtaatatttaattagattatactatatttggtctaggaataataaacctgtaaaattatctacactatgaaactaagctctgtattataacatataaatgagttctctgatcttttaaaatatgtatttctaacaaccttgtaaatgattaatatttcaaaatactgctactactgctgctactactagtaataacaacaattttgaatagccttgaatgtcttaaaagttgtaaaatataattttattcatgatgattaagttccatgtgaataagagaaataaaatgactacaaatatttaaccaaaaataaaagaacagagggtttgtcaaaagagaccaatttacttattaaatagaatgaccatacattacagtttcctggaatgaaacacttttataactattgtcctgatggccaatccagtttagcattttgtccttgattgctttacctttcaacaaagtattattatcaatgttatgattattgttatcattaatgaaaataagccagatggacttttacaacctctacttcatactcccaatctttgttataatcatgtctaagtagcacgagacaaattcagggaatgcagttctcaccttaaatgggagttaatcttaaagaagaccagcagtaataacctatctcttcccatttcagactcaacgtaaccaatacctgcctttcaaggaaaactcatatggggctcactgacgaaacaaagcgagtttgcaaaaaaagatttgacatagtcaattctttgtactcttcagtgatggcagctgccttagtggaaaatgtgggaaattacagattggggtaggtgaattgaagataaaattatttatttttgttgttataaatacaaattttgatataatatagcatcatgtgtaaaacaattttcctaacttaagaaatatgtggaacagaaatatttgaaatgtggtggtgtacaaggaagtgagcttgaagaaaagagggtcccaaaaattcacgttttacaccaagagaaataaaaccgtagtagtcacaatttatgaatatttttacacttgtatatatatacttgtgtatttgtgtgtatacgtatttgcaactgaattataaactttaatgattaagctgatttgaaataattttaggaaatactttagtatggcaatacatacttggtctttttgttgcccataatcaattagatttgagaaataattaacctttgaataacctctttgcaaatttacttagttatcctagcaaagtattaaatattttgtaaatgagtcctgacatttctgattgtatgtttttcaaaattgttggaaatctttaaacaaaatcctggagcatccaaatttcaactactaaagattataattttttgagcacccatatttcaaatatgaaagcttttggcaaattgcatttattgaaaataaagctttcatacaggaagatattgatagctcttaaaaagcaagggatacattgaattgattagatgataagtgggcaaatggtatggaggatgtaattttaaaattctctaagagcatattgaaatgtattaacttttaggaagaattttgatgagcccctatttttcagtaaatttctttttaaacttgtattacattttattttgtctctattttttgttattattattatactttaaagttctggggtacatgtgcagaatgttcaggtttgttacataggtatacatgtgccatagtggtttgctgcacccatcaacccatcatttacattaggtatttctcctaatgctatccctcccctagcctcccacccaccaacaggcccaggtgtgtgatatttccctccctgtgtccatgtgttctcattgctcaactcccacttatgagtgagaacatgcggtgtttggttttctgttcttgtgataatttgctgagaatgacagtgtccagcgtcatccatgttcctgcaaaatacatgaactcatccttttctatggctgcatagtattccatggtgtatattgccacattttctttatccagtctatcattgatgggcatttgggttacctccaagtctttgctattgtgaacagtgctgcaataaacatacatgtgcatgtgtctttatagcagcatgatttataatcctttgggtaaatacccagtaatgggattgctgggtcaaatggtatttccagttctagatccttgaggaatcaccacactgttttccacaatggttgaactaatttatattatgtaccattatagaatgaaaatgaagtcaatgatttgatggtaaagagctgcatataatatgactaatactaaaataataaataattttataagaactgaggtataggcccaccagcataatcaatctaattataactatttcaaaaattctattattctaattattcaactatctgcatttactatcaaaaatgcttcagcttgagaataaatgatatgatcatcccagttttgatcaagtaactattggtggacacttttgtgcaactagatcctaaaataataaaagcctcttttcttcatcatgatagaaataaaaattcctctttccaagtgtctctttatgctcatcctacaggaaattcaattaaagatattatacaatactggatgttaaggctctcaatcaaatgttgccatttatttcattaaattgtcttcgtaacaggctaattaaattattgcccagtttagaatgtaatttctatagcttatacaaccaaacttaatatccttaataattcaaaaacagctatatttttatacttgaaaattgtttctgcatgttgaagattacagatttgcaaatgttctggcaagtgtgagcctctttgaaagtagatcatatccttaaatgaatagcaaataaatcacagccacaaaattgcgtatattgcattttgcaactgatagcctcttagctgctcagactgttatttaaataaaatgaataattagagcagaaaactgaagagaaggtgttatttttatctctgtactcaatagaatgttttcaagacaaaaattagtaaggagcatgcttgctcaatttctttaactttaaatcaatgtttactctctgaacacttatattgtaaatgttaagtagaggcttagaaactgataatactaataataaaaaatgaaaaattgagtaggctatccagttatttgccaatgtttaaaagctatttggcatattattggcacaatttagctgacataactcaggtgcttaatttcattaatttcaagatagtcaaaacatttggcatgaagattaaaggaaactcaaaatataaacagaattaaaataacatcataaaaatagtagttgccgaaataatgaaaaaagtgttaatagcaataaattaaggcacacatcaatcaatatgaaaacatactataaatgatgtgaacaaaagatacaagttaaagaggcaaacagtcaataaatatgcgaaaaattaaactcacaaataaataaatgcaaattaaagtataagcataatgaaatttttgctctccaaattaacaaataatttattatctcatttctctctgtggacaagaatatgaaaaagatattctgataacctcctggtgaggcagcaatttagtataattttttgaaaagtaatttaaggccaggcgcagtggctcatgcctgtaatcccagcactttgggaggccgaggtgggtggatcatgaggtcaggagatcgagaccatcctggctaacatggtgaaaccccgtctttactaaaaattaaaaaaaaaatgagccgtgcgtggtggcaggtgcctgtagtcccagctacttgggaggctgaggcaggagaatggcatgaacctgggaggcggagcttgcagtgagccgagatcgcactactgcaccccagcctgggtgacagtgcaaccctccatctcaaaaaaaaaaaaaaaaaagaaagaaaagtaattttaaaatacatattaataaagatattatacagtatctttgtatgtctttgaccatatgtctatttattttaaaaatccatccctaattatcagaaatgtgaacaaagatttatgcatagtgattttaccgctttttagttataaaaataaatcctgagtatgacctaaatgtacagcaatagagtaatagtttaattaagatgtattcatagaatgtaaaaagtattcaatgatatgaaacttctttatttttaagtgaaaaatgatggcaaaaatatatacctccaatgtatctatgtctgtgtctatctaaatatgttcatctatcaatgtatctgtaaccctttatgtttacaaaattaaaacttagaagactatatctcaaaatgtcatttcttatttgcatcactgttttgacaatgaaaatgtatatttcctttacaatttgagagacattttacaaaaaaattagtccaaattttgtttaaaatgttaagagcagcataagttttgtaggactttaaagtaagaaagtaaattaaggtttttcataagatagcaattaactggtcattttaatctaaccagtaaatttgaattaatttgctgctaatgggtttgctttagtttaaaagtatatggagtgccttagactcttcaggctactataataatataccataaactgggtagtttatacacaacagaaatttatttctcacaggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagataccacctcctgattcgattatcttcatggttaagatttcaacacatgaacttggaggaacacaaacattcagatcatagcatggactatttgttattagtattattattatttcttaattacaagtttaattaaaggaaccaatagctagggaatacagccaagtttgtttacaagtatgaagaaccaccagtgctacaatcacaaaaaataatctatgaaaccactgttgaaaatatttttatgttatattgcaaaaatcactgaatttataccagtgtttatggcaatatttgcccaatttacaatcggaattatgttggtacttttttatatgtcaaagagaatacaaaagtcgctttgtccttataaaatataatcggtagattaaattttaagctcactgaagtacaaataagctatctagatagtataaaaactagttagaaaaaaatttcaaacaaactgttggtttgagtttttttcttcacagtatataaacatttaaataaaaaactttaaaataaacttcacacccagttttctcatgtttaagaaagtcagtacaaagtagtagttaataaagctggataagaagcagattacctggaactaagttctgctctggcacttataaattgtattatttagggcaagttatttaacttctctgttcttcagtatcctcatcaccaaactgggaataataattgtatctacattaagggattattttaaagatacaaagagctaataaaatgtaaagcacataaaagagtacccaggacacagtaagagcttaatcaatactaaccttaattattgtgccctcagtctacactcatacttttcacagcaaatcttgagtgaatagtatttactttttttcattcatttcagaagcatttgttgagtacctaacaatatttgtaattttgaaggcaaatgttggataagccctggtggggaaaaaagacaaatgtaacctattctgacctcaaataatgcatggcttcatgatagagagaaggatcctataaaaaaaaacaaacaaaccaaaaaagttttggaagtacagaaatgtactggctgcagaggagcaggcaagacatagaatctaggcagggggttgggattaggaagggctagtctctgggaaaatcattcatgctctggggttcaaacaatgcattgaattgtcttgaaaaataaagtgaaatagatatacgggggaaaaataatccacacaggcacagatgcaaaagagattgtgatgcatttgaggaaatggaagaaaactgatttggctaagttcaggatacaggtgggaaagagaattgtgaaaattgtggctgtataactaaggagaggtcagattatgaagagccttcaagtagagtaaacgtataatttattgttgtaccaaactatctttgcaagtgagggggagaatactaattattttacccagaacacaagcataaaacaaaaatctccatagtgacttggaatgtatagtacttctaggccatgattactttcatctatgcatctatgttctctccatctttttttttttctttttttgagacagaatcttactctgttgccgaggctggagtgcagtggtaagatcacagctgactgcaaccttgaccttctggactcaagcaattctcccacctcagccttgcaagtagctgggactacaggcacatgctgcgacacctagatatgcatttaattttttgtagatatggggactcaccatattgcacaggttgttcttgaacccctgtgctcaagtgatcctcctgtctcagcctcccaaagtggtggtgttacaggcatgagctacagtgcccattggcatcattttacctttaccttgggtacatgtatgtgttgcataagggagcagggagcacagggagaggagaatctcacaggcaagggggttctggtaccagataaaggagatagatacaaagataagccaaaccacaaatgcttattcagcattcttcctgaactatctttcctcccctgaaactcctttttctttgttttcttcttgtgtctttgattacttttttcaatttcctccatggggttctcttttttaatacgaatttttttctttgcttattttcttttctctaactgtatgtagagagatatgaaggcaaacataaccctccctacagtgtcaatttcaatcttattttaatggttcctgaatgtttctcttggtactgaaaccagcccaacttcctcacagaactgatgtttatagtttttagataaacataaaaattgactcaaccaatcttaaaatgtaaaacttaaatttgccttatctgagttcctttctcaggaaacccactctcaggactcccaaataatccataagtatctctgagtgacttttaggtgcccagtaactatagcctttttcacaaatcagggtctcatatctaatgctgggtccagtaagagactttaaacttcatcttaggccctccaatatgactataatatttgcatgtcactaaaatattgtggtgttaggaaggaagaaggacaagagaaaaattcaaagaaggaacttgaaaacatttttaaagttctatgtaaggaattccacaaaaacaccttttatatttttttcctgcaagaataagaaaatccaacgcaaaattgcttaagcaataagcaaaatgtattatttcacatattaggaagtctaaagtttgaaaggtttgacagttagataattcagtggcatattgacatcatcagtgacctaagtgttttctatctttatgacctgtcatcctcagtgaattgctttgccttttatggacccaagatgactgtaaaatgtagagaggcataaatgcagtctttccttctatgggtctccttaatggactttatccagatggttcccagcagatgtctcttttcagcctatttaccagaactgtgtgacaagaccaagccaacactatcaaggagaatgttcttgatctgattcttttaacccatctttatttacttcttggagctaaaaataatccagagtgcagggacacgagatacctgaacaaacctgagcttctattaataaagaaggtggaaaatagtggtttacaggaaaacagcagtatctgctacattctacattcattctaggttataaaacagttcctcacgacagagctagacaggtgtagaaccatacacgatcaagatgcagcaaatcaaagagctgtgtgtctaagcatctgaaatccatctttgacaatgactatatacatgatatgaaaaaaattttaaaaggttaagtgatagactgatttgagttgaatctaagccgctcttcatattagttgttctattccttcttatgctcctcactaaacctcagtttcttaatcaatagtcggataaaaatagaaaaataatgagaggaaagttctctgtggtaacacttatatgattctgtagtagtctgactgtttgtgcctttaccttatgacactataaacttaatagacttccaactcccagtcccacatataaggagcttagaagccaccactccatcgtaacaataggtaaaaagctgaacaaactgaaaagtcaacaattctttttagatccataaaagaggtgaagatccaggcaaactagtggctccaagattagagagacacacagacaaatacagaaaggggagtcatggcttatctaaacagagacttacaagtggaaaccactgcaggaactagtgccagggtagaaaaacctaaactgtaattgatgaattgctggagaatcagcgtggacaagtcagagtttacagctccagaaggacctaagcataagggagactccatacttttgtgtcttttatctctaagaacttgacccagtaaatattggataaaaatttctttgtgctttcagcaaagtgaggggaaaatgaatcattttgaagcatgctagaatactctcttcttaaaaaggcctccctgaagaaaaactaattaactagaccctaatttcataggagtattatcatagtctaactaacctggaggaaaggagatacccgacttcagccaggtctattattccacaaggcagaaggaaaataccaatgtccagcccactgtagccatcttgtcccacctaaaagcaaagaaaaagctgagatatacttatgaagtacagtctagaggcataggatccctgaaagacttggaactaatcatgagactatgaacatttctcctcccacaccttaccaccacattataaatacttatttacaaaaagctagttccttgaaaagatcagtaaaattgataagcctctaaccaggctaagaaaaaaagagagaggacacaagttactaagtaaaagaaataaaaaaggatatatcactatagatcccatggacattaagaagagaacgaaagggcgggcgtggcagctcacacctgtaatcccagcactttaggagcctgaagtggggggatcatgaggtcaaaagatcaagaccatcctggccaacgaggtgaaaccccatctctactaaaaatacaaaaattagctgggcgtggtggcatgtgcctgtagtcccagctacttgggaggctgaggcaggagaatcgcttgaacccaggaggtggaggttgcagtgagctgagatcacaccactgcactccagcctggtgacagagtgagactccaactcaaaaattaaaaaaaaagggagagaataaaataatactatgaacagctctatgtccaccaatttgataacctagaggaactaaactaattccttgaaagacacaatctgtgaaaactcatgcaagaagaagtaaataatctggatagggctatactttttcaataaattgaatcaataacacataaccagtcaaaacagaaggcatcaggcccaaatttattcactggcaaattctaccaaacatttaaggaacaaattgtattaattctctataatctctttcagaggatagcagagtaaatgcttcctaacccattctattaagccactattaccctaagactaaaatcaaacaaaaacattataagaaaagaaaaccacaaataaagatctctcatggacatagatgtaaaaatcctcaacaatatattagcaaatttaatccaacaatgtatgagaagaattatacaccattaccaaatggaatttattccaagtgtacaaggttggttcaacacttgaaaatcaattaatataatccaacacatcaacaggatataaaaaaaaagatcatattaatagatgcagaaaagtcatttgacaaaattcaacatacatttgtaataaaaaaaaactcagtaaactaagaaggaaatgttctcaacttgataaagaatagctacaaaaaatttacaactaatatcatacataatggtcagcaacatttccaaaaagatcaaaaaaacacaaagatgtctcctttcagcactccttttcagcattatattagaagtcctatctaatgtaataagacaagaaaaataaatataaaatgtgtacagattgggaagaaataaataaaactatctttctttgcagatgacaggaacatctatgtagggtatccaaaagaatcaattaaaaaaactcctgtaactaataagggattaaagcaagtttgcaggatacatggttaatagacaaaagtcacttgtcttcctgtatgccagcagtgaacaagtggaatttgaaatgtaaaacacaatacatctacactagcacccccaaaataaagcttgcaggtataaaggtaacaaaatatgtacaagatctatccaaatgtagagaaaataaatcaaagaactaaataaatggagagaattccatgttcatgggttgtacaacacaatgttgtcaagatgtcagttatccccagcttgatccatagattcaatgcaattccattaaaaatcctagcaagttatgttggggatatcaagaaatgaattctaaagtttatatgaagaggcaaaagatccagatagccaatatagtattgaaggagaagaacaaagttggaggactaacactacttgacttcaacatttactttaaagctacagtaatcaaaacagtgtgatactggtaaaagaatagacaaatagataaatgaaacaaaatagaaagctcaggaataagcccacaaaaatattgtcagctgatcctgagaaaggagaaaaaggcaatacaatacagaaagagtcttttcaacaaagagtgctgaaaaaactggacatccacatgcaaaaccatgaatctagatagagattttgcattcttcataaaaactagctcaaaatgaatgacagaactgaatgtaaaattcaaaactacaaaactccttgaagataacatagggtaaaaaatagatggctgtgggtttggctatgatcttttagatacaacaccaaagctatggtccataaaagaaataattgataagctggacttcattaaaattaaaagcctctgctctctaaacagaaagtgtcaggagaatttgaagacaagccacagaggaagagaaagtgtttgtagaacaaacatctgacaaaggattttattcaaattattcaaagaattcttaaatcacaataaggaaacagcctgatttaaaaattggcaaaagaccttaacaggtgcctcaccaaagaaaatatacagatggtaagtaagcctaccaaaacaggtttcacatcatatgtcacaaggaaaatgcaaataaaacaataattagatattactgtatacctattaaaatagccaaaatccagaacactgacaccacaaaacgctgggaaggatatggaacaacaggaacttttatccattgatgaaaggaatgtaaaatggcacagccactttggaagacatttcagcagtttcttataaaactatacatactcttaccatgcaatccaacaatcactttctgtggtatttatctaaaggagttgaaaacttatgtccacacaaaaacctgcacacaagtgtttgtagcagctttacttgtaattgccaaaacttggaagtaaccaagatgcttttcagtagatggatggattaataattcagccaatggaatattcagtgctaaaaagaaatgagctgccaaatcatggaaagacatgaagaaagcttaaatgcatattactaaatgagagaagccaaactgaaaaggctgcatatccaatgatatgacattctgaaaaaggcaaacctatggagacaataaaaaataaaatcagtggttgcctggggaggggggcaggaatggagcatagaagatagttaaactactccctataattctatagtggtggatacatgtcattatacatttgtccaaacctatacacaaggagtgaaccctaaattaaactatggactttgggtgataatgatgtgtcaatgtacgtttatcaattgtcacaaatttgatactctggtgagggttattgataatatgggaggctatacatacacaggggcaggggaaatacaggaaatctctgtacttacctctcaattttgctgtgaacctaaactactctaaaaaatacaaaaaaaaacctctttctaaaaaaaaactctttaagttgaggaatgtatcttcttcattgtgtccccggtagctagtacagtggcagaattgatggcttttaagtatagctaatgactgaaggagcatgttataaaatatttattaaagcctgttctataatatttggcaggtaatagacatttaataattattagatcatagctgatgatttgactcttgacagaactaattgctacttacatttaaataatgctaattagaatgacaggctattggaaagcatgcagaagaaacatatggaagttaataaacctagagtcaaggcctgcccttctcacagttattcaaccctaataaatagctttctcttgctgactctcagtttcctcacttataaaacgagcacattacctacctcataacgctgttgtgatgttgtgatgactaaacatttcttacagttactaagtggctctatgatcacttcaataaaactatgtgccaagtttctatgtaatgatagcctgagaatccccaaaagtattggttgctttccgaccagtcaataatagcttactaatttatctgggatctcatgtgacttgcttcgtctgttccaataaatttagcataaattcaatttgttcaaaacccactactactactactatctaacatttctagtatggctactttgtactaggttcttttctaagtattccatgcattcattcatggaaacacttttattattacattttgcagttgctaaaactgcattttacgtaagacaaaattattttcctgtgtttatacagtttgtgagaagcaaaagcaagttgtatacccaagtttgcctgattccagagtcaggttagttatccaccatattataacaacactcaggcaaagtttacatgtctagttaatgtcaataatggtataaacaggaattaggtaataggccatttttggctctcttagtgagatagtaattaaacattttagctgaaatttctctttactataacataccacttgataaagcatacattaattctagtctggttttgctgttgagaaattatctacatttactaccttattataacatattattcttttcattttaaaaatggccattaggtttatcttacttataatacaaagtgtactttatttattttttaacttttattttaaatttaggggtatatgtgcaggatgtgcaggtttgttacataggtaaacttgtgtcatgggtatttgttgtacagattatttcatcacccaggtattaagacttgtattcattagttattttttctgagtgtattttaatagaaaactaaacactaatgaaatcactgaagatatcataggaatataaaaccctcaagagatgatttagagttttccattttcagttcatggaaggcaaggtttccactcaacagagaaagtacaaaatggcagtcatcaggactaaaacattacaactgtagaagttacacaatgtaaagcttctgatattataggcacaaattacatcatgaaaccatttcactagagcacattagtaaactcagtttccaacggatttcccttggggccctcgccgtattgaaacaatcactatcttaagaagaaaaatgtgttcatttgttcccatgaaccagcacctagcatacctgtcttccacatcataggtatccaataaatgtttcctgaataagcaaatgaagaatgaatgaatgaatgaatgaggaaatagggaattcaaatttcttccagtcttgaaaggattgatagtctatgtggacagagcatagatgtaaatagatttttaagaaaacaaggtgcagacatgaatatttaaagaactttctaaggactacaacaattgatagaaactatctcagagatctgtggggcaggatgtaactccgaaggcttgctatccacttataacctcttccactggctaagggagacagtagggacacactgcatagaaacaggaagaaagcaataattaatgttttttaaagaaaaccattaatagttaattaagaattaagggcccatggtctctgaggttggagtcatttcaaagtactagaaaaaatgagcatagggaagaaatcatattcataagtaccttgctctaatatttccaaatgtacatcaagagaaactgttgcaacttgctgactttaaaattctagccttctctggcttcatgaaaaacttgctagcctcctgcaaagttacagttcaatctgcttcacattgggtaaaacaatacccaaggtacagaggtgctgaaaggcttagttattgttagttatgggagttgacaatcttgaataaaaagcactcttagtgcaaagtagaattgtaatcagtgtcattgtcatttgaaccacattgtttgcagtgtaaccaattgtgaaaccaacataaattcaaaaactaaattagaaaaacagatgcttcttttgtttggagattttagtcccatctagccatattgtatatcattttctttgacttacaccacatagaaagaaaaatcagagagcataatacaaaaatgcagaaacatatttagcaaatttgtggatttcataagtcatttataaactttggatttacaaacaatttcaaaggcttttgaaaatatttttttttttttttttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcctggctaattttttgtatttttagtagagacggggtttcaccgtttttttagccgggatggtctcgatctcctgacctcgtgatccgcccgcctcggcctcccaaagtgctgggattacaggcgtgagccaccgcgcccggcctgaaaatatttatacacacaagaatctctataatactacatataattataccatggcttttccaaagcatattccagagatagactttcggcagaatatcaagtttcctatttggggtttgtcttggagacagtgaacaatttatttttcagtctctgtctccactgatgcttgtgattaagataaatacattggtgcaatgagagaaaagagatttatcttgtacataatttctaaattgacttgtgacattaggaagtcgatctacccagagtggaatttgtttcttcagttcactgaagttcagttcttcagttcactaagttccaactaatttttgtttctccacagtctcaactattttttaaggaaattgcgaagttcacttttaatgtttctgaactaccagacttcctatgatttaaaaaataacaactgtaaatttgcatgaaatctttggcattatatactcaagtatagcttcaattctgggccaatatacaatgctgatttgtgtaggacaaatatctagaaaaataggtatttttgaaaagaagataaatactctaccaatgcaagttcaagatgaaataagagctacatgcacacacacacacaaacacacacacacacacacacacacacatccatctgcatcacatatctcataagcactaagggaaaaaaaacacacttttgtgtttatgatgttaattttaagcaatcaaaagtataagcaataacatatgttttgccaagtttacagtacaccattgtggttataagcatagggatttaagctttgttttcaatagtctgaggtgcttgcattttgtttatatcaacattttacttccaacaatttttttaaaagtcatcttatttgtagtctaaatagttcttggtaaaacacaaaatctcttagtgagtagcaaatcggggccactaaaaataaatttcctctttgttgcaaatgagacaaaaactgttgtatttagactgtgggggcagttaacaaggtctaggaaacctcaacctgctaccccaaaccttttgtctgactacgtggataagaacagatgacaggagagtgggtggcttcctggagagaacttgggctttaactcttattaactgtatttcctagtagagtagcatctgtgcatactagatgtgtaagcttcaacaaatgatcttgccctgagtctgttttattgtctgtaatatgggtaaaatattatatttttatgagattaatttaaggatttgatggcacaatgcatgcagaatcattagcatagaacatatacttgatatttctcaattcttcttgatttccccttcctgtctttctttcctcattttcaaacaaatcaaaataaaactgaaaaagtataaagtatatcacgggaaaatttagaataaaatatattttatttttttctcaacattagaaagtcaactaaaaaatgagcagctatcataccaatacatcgtttagtatagggtagtcagttgacccacacagtaatattaagtcaattcagctgtctttgaataaaaggaaagagtaagcaagcaaaagaaagagagaaagaacaatttaataattacagaggattcttcccaccattctaataatgaatggagtatgaatcacctagcaagcaagagatggcagacatgatttggctttccattcaatcatcacccatcattgaaagatgcttattttcattacaatatgacacctaaattcatgccaactatttcatctgaaactcaaccaagaaaatggcaatctgttctaatgctgaaggaaaatactggttttctagtcttcaacatgacctttcagagagattttcaatggaccttttaaatatacatatatatgattttcttcacacttcataactttagagcttaaattcacatttgtcactctactgtactaatatttaagtacacaacagaatttaacattgtattatcattaaggagcatattagaaagttaaaatattctataaaatatactatataagcaatacatatgttcagataatttgtacttttggttattaaaaagaatttttaacaataggtcatcaaatttttgtagttgaagaaatattttcagattttgcgatttagaattgaaatttcaaaagaacatagacagtaaaagtaaatattagtgaaatattgaactaattagagggaagccaactgagatatttctaaaacaaacaaaaaaactaagtgtatttactacatttgtagggtaatggggaagccaaataattttcatgggtttcagaatgaatgatcaaggtggaaagcatagaaaaatacttgggaacacctgataagcaaagagtaccagccccatacacacacttacatgcaccatacacacccacctgttactcaagttttcagaagtgaagccaccaaaagattaaaataaatattggtgacaaaagataggtgctgctggagtagatcaaggttaatggaggtccttgaactctttgggatatcaagaccaaaaataaaagcttcctttgaagtttgttatctggagaatcagacagacttcttactcttccctggttctagggaccatgtgacaatttatggcaaatgacattagatattaatctttgatatttagtagcatagatcataagcctttttcaaatcaggtagctagaatcatattttcaaagtacaagcccttaatttccgtaatagctacaaaaggtggaggaggacattttattgagattattgttagccagccacccacacacatgggatccaaagtatagtgttctttgcttcatattcaaatctaaaatccagcacatactgagcccatagtgaaatgtgtttacatacacccaacagacgaaagggaggcaacaaaggagactgagaagaaatggctaggattttcagaaacaaaattaggaggctgaggtaatcacttgtctcttcagggatctgctacttcttgaagaggatttatgggatgttacaggtttctgaggcttaccctctgttgtctataactgcttattcatgcaggacaagagaagaaggttaataagtaccctcagggatgtaatactgaaggactttggccctaggtaaataaaaactccaccattttgttcattttaaggctggaattctggtagataagtcaggtaatgtgcagtgaagagctatctatatccagatatcatagaacagattgaggtgtcctagaccatggctcaagatattgcaatgatggcataagatagttggtcaaagaatgaacaatacaagagctgaataaacataaaataaaatgtaggagaagaaaaggaagccatctttaataccagttattataaagaacaaagaatgtgagtgagaaagatagctccttgtaattcagaaaaagaaagaagcaaatgagaaaagaggacataatcagaacttgaggtcaatcagcataataattttagggtatgggtaatcaacagagtaaacttacagtcttattagataaagggaactacatactatgaataataaagcacttatgccatgtgcctcaagcttagaatccagaattggaagtgcataacttaatggaaaaagtccacagaaagtatacaaagctagatagatctatatgtccatgaaatataaatttgtgaggaaatccatgaatcagaaaatggctgcaagctggcagagtcttattggaagcaaagaaaagaaggcatacaagtaatatttatttatgtgggacacttaaagcttttcagccagagaaaatggaaaatgcattactgtcatatatcacaaagcacatataaaagcaaaatatggtaaagatggtgagctttggttatccagatttattagttttttattgctctgtaatgagttaccacaaacttagtggctttaaaaaaacacccatttatttgctcaggattctgtaggtcagaaatctggcacagtgttggcatgttctctggtcaggatgtcacaatgccaaaatcaaggtgttaaactcaattgccatttggaccctgggatagaatccacttccaagatcattcaggtttttggccaaatttagctccttgtggtcttaggactagggtctctgttttccttgttgactatcagccagtggctgctctcagctcttagaagccatctacatcccatgccacctgccacctggttgccttcatcttcaaactagcaactgtgttttgcatccatctcctgctttgaatctctgacttactagtctgtgagcagacagagaaaaatttagttttaaagagcttgtgtaattacattaggcccaccctatcttaaggtcaactgtgccaaaacttaataatgggagtaaaatccatcatattcagagtcccaggaactaggcagggaatgaacacgagggggtgggaaatctcgagggccatcttagagttctgcctaccacagtggacatctgtcgtgggtcttcctcagcaaaagcagaacaaatgatcactggtgacgtgataaactactgacttctccataaggcatgtgagcctccctctgctctgctctgctgtagtcccttgggatactatatcactctctcgtgctgcccttaagagaagcagtaccaaattggaacatgtttagagataaaaaatgttcttgcaactgtgtatagaaggaaagcctgaagggtctgagggtgtttagtgtgtaggataggggtcatagagacaaaattaattattttattgatttaaaatatttgcagtgttgccacaaagtaaatattcactgtgggtctttaaggtgtacagtaacaatgaataggtgaaggcaacaagaaagaattctagtgagagacatagaaggaattactaggaaaaaaattatggaaaatccctggatatacctagctactttatcagatactttattctttagaatataggtaactagaaattaaagaataaaatgaatttatgatcaaattggtaaaagaaactctaggttaagcaagtaagcagccttttcctcccactgcaggatttctcaaagactttattatggtccgtaattctcagaaggaaagatatggcatgcaaaatgtttcaggttaatagaacatcaaacatattttttatttagacacctttaggactggtattttacaaactttgcttggtaaactgctgtgtgttatggggaatttgtgtatcagagagtggttcaacataaccactgcaatctctttttctatttcaggacacatttgggtacttagctagagctgagtcatctttattaatgtgagctgaatatctacacagcagccacagaaaatgagtggtacctatttgaatgcctatgggacttaactggattatatatattctcacagaaattagttagaaaacggtgctcaaaactttgcctcctcaaagtataagtaactggatgaaagatcacctgagcaaaatcaattgtgaaaaacttgttccagattcaacaaaaattattaacaatagtatattagttcattctcacactgctgataatgacatacatgagactgggtaatttataaagaaaaagaggtttagcggactcacatttccacttggctggggaggcctcacactcagggcagaaggcaagaggcacatctcacatggcctcagggaagtgagagaatgagagccaagcaaaaggggaaaccccttataaaatcctcacatgtcgtgggacttattcactaccacgagaacagtatgggacaaaccacccccatgattcaatcatctcccaccggggtccctcccacaacacaagggaattatgggagctacaatgcaagatgagatttgggtggggacacagcaaaaccatatcaaataatgatggaaattaagaaattattgtgatctgctattctcagtaaataattcagaaaaaatctcaatcttcatgatttgtaaatagttgaaagctagtgcacttaatcagcttgggagctgcatcttggctgttctcataaatctcttgttgaggaagttcattgctataaaaatgttagaggttttccctattgcttctttgaatactaatcattccaccttccttttatataacactttgacgaaacgaagctaggactatcctgatatggtgaaatatttctcatagtagattctctgagcttcattatagagaatgttgcagtccaataaattcagcaggttttgtcattttaaaatttttattaaaaaatctttaagataaaatataactaactcttcttagcctcagtataccaaaaagcagatattagtaggaaaaaaaaaatataagggaataccttccgaaagaatctcacaattcctgagctgaaaaaaagtcttctatattcttaattccagctaagcaggtaaaaaaatctagtactaaagagatagcaaggtgtgactggagcccaggccatctaactcagtccaggtctcttacattaggttttagtttttgtaactttgttctattatctatactcctcattatcttttatgtatgtgcgtgtgagaaatattgtaccataaatatgataaatttattttgtaattatctgtcattatataatcaaatgtcaaatagtcaaatgtccaaggtagacatatttagttataatatcatttctagtagcaaaccttgaaatctctaatcatatgttctccatatctatttctcttcactgatgactgattttttttttactaccgtcaacatcaaaatatatggaaaatccattatttcaaaagagcaatttcagaccaattttcaacagaaaagtactcaaataataggctctaatgttcttacatgaatactgtataaatgtgtccatccctgcagaagttcttatcatatcctgcaaaatagcaaagctatcagttactttcggtaaagaaacaatttccattttactctaggcctgtcttttgggttacatcaatgtctgtaattcacatttctaattttaagttaataaaatttgatattcttcctgttaatcattgtaagcatgggggaggatctgaaaaaacgtgagatggggaagacatgttttaataagaaattcctaaatggaacttgattttttaaaaaagaacttgacacaaataaaatattcttaaaaatagaacatctcaatctgtccaaagacaggtaatatccatgtaaaaattctcatattaacccaccaatgtccttcagcctgtgttgagaagcaccaactctcaggttgggggaatagtttatcctcccaggtccactcaattcttggcctataggctgagattgccacctggggagccaattagtgccaaatatgttggtggttttctgatgtaggaaaatctcccctaagaactggactgagatgagccatcaaatgatagtgactttcagtcactaatgatctggaatttagatagagacttttaattgggttaccaagcaacctgcaaatattttggtgatacctgctgagtcaattgggtagtttgtaacccactcttctctgattatgtaatctttgatatgagtacattacatgttataaatgatcagcatggtttttttttctttgtcattagccaagaaaagacatcactgagtcttttgttcattccttgcattatgtttccatgtgtccaaaagagggtacacagagtaaagagtggttatagggaatagagaataagtattcattaagccatcttcttatgccccagtcttctgctaagtagagttagacctcgtgacatcagaaaaggctacaagcaattgttttgtaaatcttatttccacttaattaacagagctggaatttcatgtctgtttcttagatcattttttaaaacataagaaagtgaaatgtgagtgtattgttatatggttttattttaccagagttttattttcaaataaaactttcaagaaaaataaattctgcctctcgttgtttccagatgcctctgtcagttgctgtggtccagcatattcactttttcctgactgctcctgtcatttccttctgtctttcttgctcagctgcctcacatgggtctcaatcagttccttaaactacaaccttgagttgtcttgcccccgtttggggtgggtattatttttcccagtgctactgttctgcccctctggcttttaggtaacatttcacattggctttcaaccttacacgtcgccagatacacagtgggctcttcagaaatgctgccttttccctttgacatgtgtgtgtggtgtaactttcccactgtagacgaagcagtggccagacctttccttctcccagcttttcttctatagccagcttttcctttctcactcatttgaactctttgctggtaggtattcctatgggaaggtgtgcactgatggtctggctttgtgtttctttgagagctttctcctctccctttgagaacttgtaccacgtgagaaataacatcagtagacctaacttttccattcctagttgtattgcaaatgcaagcagtcgagcaaatgataacaaatcatagtgctgtttcaaaggttgcattcacaggacacttagagctctcgactgcatttcaccaatgaggaaaccgagggcccaacatgttaaaaggctagcaaatgttacataattaatagaaagtgactgggaattaaatcttgtctataactcctaatcacatgttttgtacggtacctcatggtgtctcatttgatcactgtattcctgatccagtttcacttgtcactatgtgttctaaacagaagttaaagtggcagcagattcgacatgttttatatagagagatttcattcataaaatacaaaatgaatgacaatattatcaagaagggaaattgaaataaagagaaaaagtcatgtgaaacatatttagttgtgagttgaagctctaaatgcttatacaagaggaaagaatgtcccatgtcattttatgtatcatatacctgtgaaccactgtcaccctgcacaccaaagtgtcaaaaattaagtgggaaaaaatcatacacctaacaagatgttctttcaaaggattatcctattaggtttggggttggagaaacacctttctgttgtatctcaacttagcactggggcttgggaaggggtctagggaaagcccacctcttccttacaaactttcccaaatgtgagttttatgttgagtcccttataagattatttccaagttccttttgagctgaatgatcagctgggttcccattaagagccttggcaaagagaattcttaaatgtgagcttgccaaagtatgaaatgtgatttctgatagttgtttttcctttttcatttttttcctcctccttactcttctctgaccagcctgaaaagtgatacaaaccaggctgggaactacatgcttgcaacagagtaataccctaattatcatcctcttagtaagggctgcttttgacaggtgtcaattagatttaaatggttggctgtgctgttgggttcctttactttccctttttttctacactgtcattccttgaggtagggttaaatgctgacatccctttgtgcttaaccagagataactatcaaagcaatgtataaattacagctccagttacactgatgcttaggaggctcatccacctctaatgacaagatatccaatcaacctgggctatagttttgtgaacagagttgtgaagtttggttaatgaaatctcacatttcacatggttcctgactgtatttttagatactcttacaagtaggatatcctagttagttattctatctttttatctcttgcatgaataaattacagagttctgcttcttatcaaagaaagcattcactcatcatctgggaaacacaaaacactttttagaccataaattattcctaaagaaaatcttagatgagttgggtactccttgttgtgtatgtatatgtgtttgtgagagagaaagaatgtctgcttgatggcattcattctaaatgatcatagacagactacccgattgtcatcttacctgtcagtccttaaagcaaactaccctagaatgcaaacaagcaagccaccaccaaaaatatcctttccaactccttgaccaaccactgtgaatgaccgaatacacccagttcctcctatggcattttcttccggcttactggcagagaatgtgatttcgtggtagactggtagacggttggaaaatgaccccttataatgatggaatttacataaataaatgctgatagcacaaaacagataatatgctgtgggtatcatcacaataagttgtctcccactgacacagagtctaagttggaagcacacaattatgcaaatcaaactaatgccagttgctcattactgtcatggtggtaaaggcaaaaacatatcctccatagacagctcgagacggggccacaagccaaaatgtttggttttgctgacacagtaactgagtcaacaaaaataggatataatagtaatacatcaggggaacccacatcagggtagacctgaagcttaatggactgtgaatcctatgtctgtgcagagcaccctttcactggtattgacccataatacgtctgcttccacatttgccgattatgtagaaatagattacagaagcaaatttttttaagacctgaaatgtctgcaagatattctattagcttttcctaaaacagatgatatgacatttgtaaatacttaaataatgtcacatatcccaggctaaaacacttcccagaatatttcaaagtacctgctgctgtttgatctaggtttgtcctgagttctcattatggcactgaagatgttttcaaacaatagaatgctcatttgccacataaacatctttcctatctttaaaaaaaaatagaagagctgtcaccaggagaatatttaaccctgaatatttcacagaaccttgaaaaaaaatttggccctattgtaggttagtgaagcaacaggtgctgacccaccaatttaatccatttctcttctgaatgacagggtaacatgtggtggattgatgttataaatggccctgatgcttcacccttcatgatattcatgccctttgccacaagattttgctgctcttctcatcaagaagtatctttccttgccccttggctttgagtctagtcatgtgacttgtcttggccaatgggatggaagcaattttgccagaagcaaacgcatagaaaagcatctgcacactgccaagtcagcttatgctataaggacactgtctaggaagaacatgcttggccttgcttgctggagggcaggagacacatggaagagagctaagttgtcctactaaggccggcctaggccagccaacaatgagccagcccctggacagctgagtgagctcaagtcagaaccaactaaatgagtccagcctacatcatccacagattcaggaactaataaatgctgaatgctttaagcccttgagttgtatactgtttgttaagcagcattattgtgttaacagacaactggagagttttcacaaagttttacaatatcaaaaaaatacaagaaaaatataccctataaataatgcaagaaaagattatttagtcaccagatttaaaatacaaacacgggaaaaatggaaattaaatcacaatgagacaccacttcacacctgccagggagaactataatcaaagatagacaataacaaatgtttgcaaggatatgaagaaattggagcctttgtatgttgctgttgggaatataaaatggtgcagccactttggaaaactgtcaaacagttcctcaaaatgttaaacatagcaatactcctccttggtatttacccaagagaaaggaaaacctaggtccatgcaaaaacttgcacaaatgttcatgagagcattacacaaatggccaaaaaggaaacaattcaaatacggatccacagatgaatgaataaacaaaatttggtatatccatacaataaaatattactcagcaagaaaaaggaatgaagtactgatatatgtgatgatatatgagtcttgaaaacattatgctgaataaaagtagccagtcaccaaagcccatgtattgcctgactctatttatacaaaatgccccaaacaggcaattctatacataaagaagacagattgatcattgcagatgtggagggcatgggaattaactgccaaagagtacaaggggtttcttttcaggtaataaaaatgtaaacgtagatcacagtgatcacggtgatggttacacagctctgtgttatgctaaaactcatttaattgtcaataggtgatttttatactatgggaattatatctcagtgaagctggtaaaaattacataaacacttcagcctcatcttctgaccaaaacatggcttgtttcttgttttaggctctcttatatctaccttcttgattggaagctttaaagtgaaaacagaacaaatcaaaagtcttagtattgcttctttagaatcacacacgtatttgctgtatttgacacatttgaaaagtgaaataatgaagaatttttgatgttctataatagacactgatttttcacagaactccagctctgtctttcattttcatgttttctgtgatactcatgctcggcttgctcttaaaactcacctgtgaaaaagaaagggcactacttgccacatcttaggtttgcatatcaaggccaacttcagtgtgtaaacgacacttgcaccaggcatgcttggagctgttcccaatttcgtgttcacagcctctcctccagcagcaggtttgaggtttaacttgcccagttgtgagaactgagtaaatagacagcccgcagtgctgtcatctaagttacctcttctggaacccccactcactgctcccgccacagcttttcttcagctcttcatgatttttgcctaaattaccacattttctggactagctcacttgcttctggtttcactcccctcgagtccactctcctaattgcccccagagtgatggttgtgaagtgggtatcctggccatttcatacccttacaaaaaacaattctagtggcttccaatccatacagataaaagaaaaaatttcatagtataacttggaaggcctttcataatccgacagccgcgggaaatcttgccactccctccccttggagctaataaacatttgctgttctctctcgtgccttcaaataagtgctcccttgtctttatgtgtggtagaggagaagaaattaaaattacaaataaattaaatatattgggagagacagaaatggggagttgctgctcaacaggtataaagtttcattcattcaagatgaaaatgttctagaaatctgtacaacattgaacttagcgttaacaatactgtactgcacacttaaaaaatttaagagggtgtatctcatgttatatatttgttacaatagaatagatgaatttataaatatttatatagatttggatatagctttactgacctctcttcacttgataagccccctcatcctcttgcagtccttttagcaccaactctgccaggaggcctttctaaatctgagatttgtgtcctctcgtattttaagctactggatcagaaactacctgtcctaaacccacctgagcaaagcaccctcgtccatgttgccagcagtgctctatgtacacatgtacacatcacacagcattatcattcctgggttttatttttctgtaaactttttgcatagccaattgttgccagtccatataatgtctttcttttattactgtaattcattttaattagttaattcctgcatcctcattttttcctgccattactctctccctatagccacctgctgtatagcattctttggattcataaacatgtatggattcttgattgtggataagactgtgaaaatgtctgcgtattttacacataattgctattcacctgtctctctgctgctgaattggaagctacttgaggaagggaaaccagccttttcccaacctgaacaccttgcacagtgtctgattcccagtaagagctcaataaatgagtgtcaaatccatgcatgacatgatacattaatgaattaaaagccctacattttagtttaatttctaataatcttggtgggctttacaagttttatctctcttgctacaaatctaaccatgagaacttgcaataagcgctaaaaatcttaaaatatgagaccatttgaatctcagcctcttttgctgcccatgtcttccttctctggcatgtccctgaagcactctgtcccaactgatactagtagatattttagaccatctagtggacagtagcttaaatgtttgacagatttctacttctttctcaaaatggttgctgattaatagctgaaaggatcaaccccagagggaacctgaggtttcctacctgcccaaagccagctttcacattcccatttcccaccagaggactgcaaagatttttcccttgactttgaaataacacttggttttacagtctgcttgcctgtggtttaggaaccgagcatgtcagcactcctttttactgcctcagtgcagcagcaaatgtgttctgttctctcctttcaaaagtgaagattgtattttaaaatcactcttgcccctagggagccactcactcctaactccctgacaggccatgaggacctcaaaattaagaaagatgtccagaaatgtgagtttgtacagaaaggactagaaaaccacccagacatgtaacagctcggttacgtgcctggcttctgtcaggagaaatgtgtgtctgaattttcaggctcataatagacatgtacagctaaccgacttttattttgcctctgtcatattgatctatcagtgaatctataatagaagatgggagcttggaaaagtaaaaagtaataaccattgagatggatagcctgagcagaaatgtagtttcatggggacacttagtgcaaagaactgtagattcatgtcaagggggcacaagtatccccttcaaagccaactgttaaaaacacctagtgcacagatgacctgccttcagaatatgatatgtttctgtattgattttcagagtttcagaacaacaggaaatagccaaatgaaagtttctttgcagagcactaaaagtaatttaccttctgcctttgatttcagcttcagattttgttttatggtgcaaagtacaagtgcttattttaaaaaattcatttctaacttatggtggaaagcagcaccagagaccaaggaagtgtggagcaagaaatgagccatgaaatgaaacaaagcaaaaccccccaaattgcatcaatggagttagtggtaagtcattacacaatgaagtttgtcttttaagcacaggcccactgattggcaggcaggattttaccattatcagaatgaggagcctataaaatgcccaaaactgtggctttgaagtcatctatatttagcttctgtaattccatcttttgtacatccctttgcatgaaaaataaagtgtcatattcaaataaaattggccttccaggacagaagaaaacacagtttactttccagtacaagttggtaccatttgcacatgtttggtctacaataagtactaagcatggggcaatactaataatttgtgagtcttgactagacctctttttttaaagagattattcactttatattcaaataaatttggtttatacagtatatgatgatgcaaggaaacaagtttcagcttattcaatgcccaaacttgaaatttatttgtttccattgttttcttcatttggggctttaagaagttgcattaagcagagttctggcaagaaacagaactcaaaagaagcaattaaagagtttcaacagaggcacaaagcatgggcagggttaagggaattcaaccaaggagggtgaaacaagcattcctgaggctcccaaccaccaccacgtctgaagtgaagagagaagggaatgtttaaagagtccatgcagcctgagtctgaagggaaggccacccaacaggagctggggccgatggaagaggagctcagacactgccaatccatgaaccgagggaacaaacaccccgacttttctttcttcatgtcttctagcttcctaccaggggctcctattgggtgaaccccactgaaaaccagataaaaaaagcttagtttcacagtctattcatatcagcctgctgaaacatacagccaagggagaaagccccagagtgatccagaagggcacattaaaaaaaacaaacaaaaacgaaacaaaacaaaacattgtatcataagagtattttattctagatatgtgctctatactcatagaactggcaatataattgcaattcttcaacttcagcagaaaaacaaaaatgcagctttttgctgcacatatgacataccctgaccaagttaagagagagattcggctttgggaagaacaaggatgaagtaagagtatctataagtgggagaaactgttaagatcttccgaaatagaagttaaacgaaattaaacaaagcagaacaaaagcaatggatatctgttaacctttgccttccacttcttagcaaataaaacattacagcaagcataaatactgtgaaaatactcccaggagccatgggaataactaacctcttcctcactctctgctcaaaaaactctcctaatcagactattggaatatgccccctagttagtaagaaaaacaacaggaaactgggatttgctttaaagacatttaatcatagactatattttaaaatgtgcattatatccacaaaaagagtgatatcagtatcatatgtttgtcaaaacaaggttaaaatgtatatgaacttttgacttttccctgtccaaatcacacccttgtaaggagcccattttattgtaaacatttaaatctgttaggtattagatatgagctcagttatttttgttttgtgtatttttttattcacagatgtttttattatgctttctgcaatcaaatgatctgggttagaattagaggattagaatgccattggatcttactttaaaaatacaaatttatctattttcattaggaacctgacattcttatccagaaaatttacattccatactgaatccaggtattatgtaacacatattggttgtatttttttaaaaaaagtaacaactacttccctacatagataaaatatctatccattatccacctatctatgaatctaaatttacaatgaatcaagtgccaaaaatagcctagcctacttacagagttctctctacaattgccagtcactggaaaaatattcacaatcctttaagtccattaggatggttggttctcacttcagataaaatgataactatgttctgcccaaatttgctttgctttcattctttgcttgcactctcaacaaaaacaactttttaaagcttgaatatttcatgaacagttttgaatggcttcaattgttctgtatttttaaagtgcagataactgtaggaaaaatatatagctaaagatgtctctcgaagtatgttgacactccaatttcattagaacaggattaaaatgtatatttacatgttgtgtgtaaagaaaataccagctttacagtggtaagtatatatgtgaaggactcatttcagcatatgactatacatacacccacatacacatgcatagacataaacacagacacacatatgcacacatataaacatacacttacacacataaatgcacatatacatacatacatacacatacatatacatagatatatacacatacacctatatacatactcatacatagccagccataaacacatacataatacaagtacacaaacacacatatacacacatacacataggcatacacacatatatacacacatacatacacacatatcacatgcatacagataaacacatgcacacatacacaaacacatacaaatgaacacatatacatacggacatacacacatatacacatacacatacatatacacacacacatccacatccatactcatgctgacctgggataggactgtgaagaaaaaagataggatttgaaatcagaaagttggcattcaaacctgattccacctcttcttaattataatcttaaacctacactaccttttaccctatcaattacttctctagcaactcccctgaaccctgtgctctcatccataacttatatatttgtaattccctgaactctctgtataggcatctgccatcactcatttgcttcctaagtaccattgccttaagttcgctcatcacttgattttgttaacttgtctcttgtttcaagtctcagctaacttgtcaccttctctaggttcccctcttgaatttctccaaactgagtcagatgactgcctcactcttactctcctgtggccactgtacatatctcctatatcacagtgctatcccattgtcttttgaatttctgttaccttgcatgtcttctccactggatcaaaattctttggaggacagcaccttttttgtctactttcatattttcagtaccttatatggcacatagttagaatttcaatgagagttttatgaataaatgaatcttgaactcactgaatttaacttttgactcccagcctcaccaaatctttaggtactatcctttcataaagaaatgagggaacataaaattccaagtgtttcagaaacatgctaaagtaaacaacagaaagagtggagcagaagttaaacccaaggctgtcttacttcaaagactgtactgtgtcatgttccctttccaggtagttctccaaacctctgtttatcagagaaatggggctaagaaaactgcccaccctacaaggctgataaaaagaaccagagaaatcatgttagttaataatttggaacagagttacagaaaagtctaacttttttattttacttttacagaggaaatatctgtaaatagcacagagaataagtgaatccgaagagatttcctggacacgtttccttaccccaacttacaccaaaggttctctttaccaagctctatctggccaccttagtttccccctagcatgtgtgctaagcacagatgcactcctagagtttatataaaccagcactgacaaggaaagtatagaaccagaatgaagagtatgaggctcaggaaggctgctcattctatttgtctgcaaaatgccatcagtttgcagtttaaagagagaacaacataagtagagcaaagttcaattgctctccaattagccctaattaacgaattgaaagctgtttgtatataaccaaagataccttttgttttgttgttgtggttcagcaattgagatgagtagtccaagtgattagtaactaccagagaagaaggcaatttggggacaagtacatgcaattttagtactgttttatggggtaaataatgagtttagaaatgttttcactattttaataagaaaaaagaattttaacaaacatggattatttgtagctatccaaaggcaataaaatccaaggcaatctatggaaattagtcccccatttttgcaagacaaacgtgtgaatcaattgtattttccaatgctctgttgagaggaggtatctcagaaacgcaaaatgcattacttcatattagcaatgccattcctactgacaatgtaactttcagtggctctaactcgagtccaaacacacgttttccacaagagtcccatgggaacttgcaatcaccttttcatacccctaagttggtgcagatcaggagcaagcccccctggatgctaaagcaggagatccttctctctccttcttccccaactgtcgtgtctataacttacaaaatcaaaatggagtttttagaaacaggatgcttggactgaagacaggaacgtgggatggggccctgacaggagcaggaatcacatgcaactggaggggtcatcaatgagggccaggagctgtgtgcttcctttcacactgtctatccatcagtaattttcacctggtgctcagtcattttctatctattataaccaaattcccagccagctcagaatgggctggccttgaatatccctgtctttactgaattctttctttcttaactgacgctttgtggttgaacagatgcatcccagatgtgcaaaaaatagttcacattcacagagaataaagtcctggctcattaaagggaagacaacattccgtcctggcttagaataccaagatagcatttcccagagttgacagcgaattggaaaatttaacaaaagccatagaaatacttcctgggtcaccaagaaagtcataacaagagaataccattgatatgccacccagttccaagggcttcccttggcacttagcctcctagccatttcacacatactcacctttcctgactcctagttagacctcgtgttggtacccatatacctttttttctggttcagaaaggctggccccgaaaagcagtagcaaagctctagctctgcgtggtggcaggtgcctgtagtcccagctactcaggaggctgaggcaggagaatcgcttgaacctgggaggcggaggttgcagtgagccgagatcgtgccactgcactccagcctgggtgacagagcaagactccatctcaaaaataaataaataaataataaaaagataaaaaaggaggaaggtgaaatgggtgcatgcctatccttcactaggaaagcgattatagtggtctgggaaaacagaatgatgctgaagttacttgagaaaggaagtaccaccatttgctgtggccgtaatcaagtctgtaaaggctgcaaagggtctgagcatgttcctccaattatcaaaaacccattcacaactcaggaactctcaagaggttcctcccttctctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagttgactaaagaagatagaatgaaaaggaaccattgcacaaagatatgtttttatttgaccaacaggctttattttgattccccaatcttctggaactcagactttctcagcaaacaattgcactgcccactgagagtaaacagcaaacctgccaatatcacaatataccctgagatgaacacgtgtgagggaaagacttcatatgccagacataatcctgatggttcccaaatacacactggttcccagataaagtctggtgactggctaatgcttttcactgtgattaaaagcaaatactttaaaaaatatttaatgattcattattatatttttctgagtgcttaagtctattgtctcattattgtttgtttattcgtagtttgggaaaattttgttgggacaaggtaacaagatagatctcagctacagccagaagtcataatgttcagacacacattaattctgtggacaatatgagaaaatgggagcaacaattaccctataattagggttgtgaactggggaagggcaatgtccaatatcacagagggagggttgaaagaaactagagatttgacagaaagtgatcaagctcacaaacgtatctatcattgcctcattttttaatgttttaggtgaatgaatttgagtttctgtgttgagcaatgacttgaatatttcatctcactcatgtagcccttgtcacaaattatttttcctactttagaatctactggactgctataaaataaaactctaatgcttggaacaacaataacagaaaccaaaattttatgctttgttcttttacaggccccttcaaaccccaggaacaggtgctttaaattaggctgccgaaggccagtggggcctggctttattatactttggtaaataatagtcactgttgtcatcagagttctctacacttccagaaaatgtcactagccacatgtcagcagggttctttgtctaatttctacagctaaggtggcaagaaggttattagaagtaatagcaaatttaaagttttattagcagtaaactgcaaaagctaatggtgatgccaacactagataaaatcattgtcacagttaattctgaactccttatttcaagcttaataataggaaactcaatggaaaggatattacacgccccatatcactcatgagtgcctcaggcctgagtaacttgttattttgctcatgagtgaaataaaatgcagattatactgcctgctatcaggggcattgttttaattgagggtgaatgcatggtgatgaggggggctccgagtaggttctcatttttgtaaatgttatgagaatattcttctcatttgtaactgtgactcagcacatcacctttctattacttgtgggggtgtgtgtgtgcttttagagttacctttgtttcagctccagagaaatgaaagcagctggggagatgggagggtagcatttggtgcttctcaccagcatttctgcaaaagtgcctctccagcattctagcgcctttgtcttcaatccctcagtctacagaggcaaacaatggaatatctgtgttgctctgtttgtctcattccaatcctgtatgccagcacacacacacacacacacacacacacacacacacacacacacacacaaagcccttccactctgatatacactcccggccaggaataaataatacaagatgcactcctctgtgctttacatttactaagaaaataggtgtttccgagaatcaagatcacgtgggattttgtgttctttttctaaagtatgttgctctttttttcaaacaagttgaagtgatttctgatcctatgccacaaatcatccaaatgggctgccttgagagccacgcatgcattcctgctttaaggggagccttccattcacttgacacggactgtctgtaattatgcagggctaacttcaggctgcagtgtgcgtggagacgactattttgaagcaggtcctattccctttgattgaagttgaaatcctaagacttccacagccgagatcatttgtgcctctctgagtttcaatattccctttgaaatatttgtctgatgatacaccgtatggacagagcctcctacagttcagtttctgagcaattatcactccatggcaatttgacttcatgtagcagtggagaaataaaatacttaaggctgctgccagcctgcctaacaaagcttttgcataagttaaagactcagaaaggggtgggaaacagtagttaaacctttgctttatcttttaagtttgtaaaacatataaaatctgagttcaaaatcttagaggttgtgacagacttctccattagcaggtgaaattagcccccaaattataatcttgattgattcaataatgttcaactagtagtggaatgagttttattttgaataatttcctcactcctgtttctctgcatcctatttcagtttgcagtctgtcctttaaatggcatttcctttttgccaaagcaccaagctgtgaatttattgagaaatgggtgtgtttacaataagactatgccattaccaataagtcccattcatatcagaaaaaattaaacattatattcctaaattgtaaacaaacagtcctaaattccagagattattattcccagaaaggcaaagtacagagccaagagaatttgtaaatatgtacaactttacaagattgatatggacaccgatgcatgttgcgctcatctccacttatttcttattcatacacatcattcttatgtttgacaatgaatatggtattgtggcacttgaaatcctttttttattaaaaaacagaaagaatgtcagccagttaaacatgatattaggatttcatcttatttttttgttttgttttgcagcaagagaatttaaaagaaccatcaatcctctctaaaaggtacttttaataaattggcatacctaattttgcatggatgccatgatgtctggcctgcttctatttggagtctcttgggatctatacagatttttaatagtcatgagaacttgtcttgtactgtggattgtagaattgtcttctattatagtcagctatccactctatttaagacagaagtttcttttgctgctttcttggagttgtttgatggtttatgaatacataaaaatctgttggtaattataggttaacgtaattagcaaacattttaaacttaatgttttcctaggaacagtttttgtcactttttcatgattgtttaaatattatatctttaaactctgtaataatttcatctaagcaaaagccttgatctttaaatcatttgatgaaccttaactatccatgatttgtttcaaaactaagtccacacggagacttcactatgccatgtgcctcatctagttattaaatgtgtgatacgcgtgcttcttaatgtgtgcatattagctatttttaaattataattttaccatgaagaaatgaataaaacttccaaaaatgtctgtctcagtggaatgtacactatcgtagggagatacgtatatatatagtatattggttggtgataagtgtcatggagaaaaatcaggcagaaaagataatgtttagggagagcctctctgaaaagatgacatttgcacaaaaggccccaaaggaagtaaggaagcaagccatgcagctagggatgccatgcagctagccatgttctaggcagagggaaaagcaattgtcaaagcattgagacaggggcctccctggaacatgtgaagagtatcagggaagccaatgtggcagaggcagtgggagtaagaaaaagagaactgcagtggatgagatcagagaaatggtgatggtagagaatgtgtgtgtgttgggggggcatccattgagtggcttctactctgagtcagatgaacagctttcaaaggatccttagcagataagtgatgtgatctgccttatgacttagaaaagaaaacctgagctaccctgagaatagaccctcgagagaaaaagggaaggaaatagacgagttaagaagctgttgaaataatgcagatgagagatgaggaaggtttgtattatcagtagagatgggatggagaagttacattctggatatatttagaagctggggtagataggatttgccaacaaattggattaaaaatgtgaaagaatgaaagtcaaggataattccaagtttttaatctgagcaaatggaaggtcagaattgccatttattaaatggagaaaagtttgggagaagcagatttggtggaggcaagtggataaaggtttgaacatttaaggatggggttgagtaagcaattgcatctagaagtctctatgtcagggagacagcttttgcttcaagattttgaggccatgagaagaagagaagaagtccaaaggctgagttcttagacactcattgtttagagttcagggagataaggagaacccagcaagcaagactaagaagaaatgatccgtgaggaaggactggattcaggagagtgctatgtctcagaagccaagtgaagaattaaagaaatgaagcatgacagtaaaacttatacatttatttctaaataaaaataatctattcatcaaaatagcacgacatttaatgtgtcgataaatatatttaaatttaaacaaacaaattctactttgaaatctaaattgagtagtataattgttgattaaaacactcaagagattatattcaaatccctactttatttattttacagtgccatgaacattcaaaagtttgacccaattctcttgagattccaaaaattattttcaaattcttttggtctttttatagtgtaatatgtatgaaatatcatgtttgctctggggtacagtattgtttttaatgctgggcactgtaaaaattctcaaattttagaattcctaagtatctgctttttgtttgttcttggtttatattttctgatgtcaaaggtctcatatttgcatgcctattctaggcatggattgtgggagtctgagctttaaaatagtccacaagaatcattttgtgatttgggctttatctactgcctttaattttaggcatcaattttgaagtcatatcagtagccttaccacttgaagtaccaccaagtaggaggctaattttatctaagaaaagtgtttctacttcctttgtttttgattttggtgaagacatagaggggataggaggataaagtagaaagaagtgatttggcaactatcctattagtttaaatcataattagacctaactgcataattcagaacccaagttgagtctcctagcagctcccttaggggctctggggctgtcccatcacagaagccctccactgaacttcctccccagttgctcccatgggcacgttgccttgtgtcagaagtcagagtatgtcttcttccagcttgagtttctagcttctaaatatttgtagcagactttaagtggcaggataagtggataaatgaggaatatatcacagagactcacaaaactgctcaggcccaactagtgcctatgttatcagctcctccaatctctgtacttttcctttgctagagacatcacacccacaactgcttttcaatgcccttgccacaaggctctgagttccatggggacccatgtcttatacattgttatattcctggtatctgacaccatatcaggcatactaagatacttttaaaataaagcatgagaggcccaaactaccttgtttaaaaaggcagaaaaaaattgtaaagaaggatgacaaggcgtgaatatttttcaagtcacaatcataaaaatttttataaattgttattgatatatagattatatataatctatttatattagattaaatataatctggcaaataaattaatgaatggatctcatatagtttattttaagtagaattcatagtactgaggagaagtaaaatcaccagatacaaaattaacagatgttttagtagcccaaagtgtggagtaggaagtatacgttagtccattctcacactgctataaagatactacccgatactgggtaacttataaaggaaaaaggtttaattgactcgcagttccacatggctgggaaggcctcagttaacttacaatcatgatggaaggtgagggggaagcaaacttgaacttttcacatggcagcaggagagagtgctagcaagagcagggaaaactgccttataaaaccatcagatcttgtgggaacttactcactatcacgagaacagcacgggggaaactctccctcttaatccaaccacttcccaccagggctctccctacaacaatgagggattacaattcaagatgagatttgggtggggacacaaagcctaaccatttaagacatcttagaattctacctacctcagtaatcttgagagacaaatatctgttattttcacctttgaggaaactaagatttcaaagatttagctgacttgcccaaggacgtctacctgagaaatgtttcttactaggaatgtccccaggagatattcggcaatgtttggaaacatttttggttgtcacaaatgggaagaagctggaaaacttttagctggcccaggttaaaattctattagcatgtaagaagaaaagaagatatcaaaaaagaaggagagaacatatcaaagttgcttcataattaatataaagtcagatgctccaggagatgtcaaataatttgcccatgatctgatgatggtcaacttactcaccattaccttgttctttccagtaatgataactcacacttttcttcatagcctaaatgaaaaagaataacataaagcaagactcaacaaactaagggtcttcttgatactaataataaattagaagttcaagttccctatgagattaacaggctcctttagagaaagcacattattaagtacatgtccttctaagtgatcaagatgtaagttttccttgcagtataatgcttttaggcggagaggtaacagactccagagaccggagggagacacaggatgagaaagggaggcaactgttatgatgtgctatacacaaatgtgtgacagtctcaccccatgaaggctcacagctctccagttccttttgatgactgcctgtgtggccaaagtttaaaatagacttagtataagtgagtgctgtgccacaggaggagatggaagaggatgagaaaattacaaagtacaatgtagacagcttagctaggaagatgatgttgacatagatgatagatcaatcgatagatagatagatataaaaatggaaaacaggccctttcctcttaggcactacattctctgggacctttttcaagaccatgtgaggtcagcattactagccccattaacaaatgagagacaaagaatgctaaatatcctgatgtaggcagcaaagcccctacctattccatctggcccagttgcctctataggcttactttgtatcactctctttctcattcattcagctccagccacactggccaccctgctgctcctcaaatgtaccaggcacatttccatggggcctttacactaacagcttcatctgcctgtggtgctcttccctgaagatctacagggttcattgtttttctttaggtgtcttcaaatgtcaccagttcctctctccctcttgatattcctctactccattccctgctttacttctctttaaaacatttctcaccatcatattctacatcacccatctattccaatcctgcccccaacaacaaaataacctgatgtaagagcttgcatgtaggcagtgtattttgcaagtaatgccaaggaacaaaaatgggaaaatgggaagagtgaaaagagaacaaaagcaaagctaatctagcagtgcattatcaagttggtgacaaatgtgggtaactagggctcaatatgattaggggtcctctgaaagtcctgcataacacatgtcagaattgtctaccagagttacaggcttctatctcctattctttaagggtaatcccatggctgtgttaggaaagattcagaatggctgagcgggttcccataagtgttccacacagaggaacgctagggcaaaagttggagtgaggtgttagctggtcacacctgcaatcagctagttgtggtaccaatgtctggaataaaatggtcaaccaagaggttgtgaggtaggatataagaggttcatgaaagagtccagcttttgcaacactgagacttctcccagagccttcaaggcagtgtggccagtactgatttctacaatagactcgataaagaaaagctatttgggaaagggagtccctgctaccaccaggccgtcactgatattaaccatcttttttcctcctccaatgtcattctaagttttccctattcttagtcaccactccagttggtctaaactgctttgtctggagagatggctcaaaccatcatctacatggggttagaaacctttattactacaccacagtcaggtcattgtctttacaatagtccgttttctgttatcatctggacagccccaaggaagctcctggtttctacacctgctcttccatggtaccaccaagcagcaccaccacgaggagcaaccatagctcctcattcaaatcaggctcagttatccccaccaacgtgatgacttccttctgcttttggggccacttgcatgagaagcccaaaatggccaacaatggtcatagttccaagactatgacttattctgtcctctagtgaagtatcctcctgccatggtagaaatcagaactcctaatccatcagagcctagattgtaggaaggagaagcacagacatcactagtaagtatgagtgataaccatggggccaatcttttacttcatggtttctaacccatgtattctagctttggggaggtcacagcaccatatgttggccattaatttggggcatacacacttcctgaggaaagcattccaagcctacatagtgtagtccctaaactggcacctcggccaagcccccaatatatcttcccatcattctttgaggaagccacaccactgtaggtaagacccagtacttttcaccattgtattccaacatgtagattagtacctggcacgttcatcactctgaatatatgaatgaattaatcaaccaattattctctttagattaactgagacattcaaaatcaaaaaacaaagaggttgaaattcattataaactcgtacctcacattattaaagcttgaggaatgatctcttagatacaaacgtaattagcttctatgatgttgaaaaataaaattaggaaaattgaaaaattcacactttcgtaatgtatgtggaattaatctattaatataaaaaccatacttatttggcataccaacaaatcatacacttggcaacataggggtacaaattcacttatttttctttgtcctgaacactaatgaatttcgtgtatgaaaaacttcattaagaaacattgtttaaaaacaaattgtcaaaacccgactctaccagattaaatgtatgttaaaacatttaagatgacatttattgcatcaattttttaaataatgcttgagaaagctgtgaacataacttcatagcccaaaaccttcttctctttccctttgtagcatatttctccgataatgtattttgcctactgctaccaaagtaccagaaaataatgcctaaaagaccaaaatgaagtgtttcagaattaaggagaaagttgtaaatttgtaatgttttagacacatttcagtttagcgcttgatagatcatgtcgggttggttgcgagagggatttcaagggcttgggaaaataaagtcagtgtatgtgtagtttcatttttgagagaatcactttattactgatcacaggacagttgttgagctctgacagctctaagtgctgaaaacattagagaaggtccatttttttgtttttgcccaattatgaactgtaacttggtgagagaagcaatagaatctatttacctaacctaatggtaatgcttcattttaactaaaatgtcaacacatagtggtctctgcacgtatttcaccagcatctaaattccaccatggggttcaaattttttaaatgaaatcttagacccttggtagaaaaagagccaaggatttatatatcaatgtaaaaatggcctatcttaaaatatacttatcacaaatataagaaattcctaaaatttggggttttcttctatggctttctcaaaggtcagaatgcaatgtttctattcaaatgaacaattcaactagttaactaatacgaagccccttttcttatcttctgctaacctctcacctttgaaatcagttgtctaacttcaagtgttgccttcccaattaatgaagttatctacacaattttcaaaatgtgactccatgtctatgagtttgttgttaatattactggaaagacaatataatgtgaaacaatagcaaaaagcaaaaattgaaggcactagcaccttctttgtgggacaggaaaactaacaaaacttggtgatttgtattaactcaggaccacagtaatctcataaaatggctctttcttggattttgcaagatggtttcattatttagtgcaccaatcaaaaagatagccaagtttttaatccaggccaattgaaagcaaacaatcaatgcaattaagaaactaggaaaaaaaggagaaattctgatgtccagcacatatattaaacttaattatatttttcatgataaagtaaatttgctcagtggagtctcaaagtatgttattgttataaattattttaaagttttcaaagataactttcaaaattaaagttataaaagatgactcccattttctcattttcctcctcagtttttaatgagcatacatttctcacttcatccattaagaaatgtttgtggtttaaaagttcatgttgactgcaaaaatggtgatagaagaaagctctgaggatattgctataaagttaataaatcatcttcactcatcaactatcttcaacccgcacaagttataaaggattattttgttagcaccacagggtacacaatttaaatttagagaatcagccctagcagaataagtttgaattctggaagcttctaggtccccttgcctttaaacattatacgcttcagagtccttacattttcaattgacagagaaacagaaaatcattctaacgtttaccgtagcttttccctctaagggcttcttgcaaagaatttgcatgttgcaattatacctcaaattagagatttgagtttccctgcctggtcaattataagacccttggccttaccagagaatgaatacacgctctcaactttgcaaaggtctgagtcaacagcttgttgggctttgaagaacctcagccgtttttgcggctggagctttttctccttttcgtgtttcaggaccactgctggttttcattcatcttcattcagtgggtttcatgtgacattttggggctggaaacataatgtgtcagaagatagctgcagcttcctactgcgttattgtttcctttgtcagaaggtgagtgagcacaaacattttccaattgctctgattttcagacaggtttagatctactgagccatcactgatgcacacgcctataccatttagaaacacttgatatagatttcagaagagatttctaagttcagttctatacaaataaatgtactatcatttatcctttttccagaagaggcagagatttcatatcctctccttggtttaccccgatcagtataaaaggaatagatacggtgcttcaaaaacacttctcatttgggttcaaaaacagcagctcacctttctgctggaagcaaaacattatcatgatcaacagaatctgtctgttgggattcagttctgcaatcctttcatggatcaaattcccatcagaatcagaattaagtcctaagtgaaaacttaaattacattataatactcagcctcataagttccaccaaggctttgccaaaggcattgaatgatttatgataaacttcagaacctcagtcccctcttcccagggtgtcttcaattaattctttgaagaactttactcttgattccttgttgaactgaagtaataaggggtttaaggcctttatatttttcctcgaactttctcttcttaacttagaatatctgcaagtgaaatataattgattggatctttctaaatctgtcttttataaaattatggttaaatattatcttattcctgcagaatttatatgacttttaagtataaatctctatgtcatcttagttataaaaatcatatcattagaaattgccaaaatgcattacacttcagcctgaagagtaaggttcctttcagttagaaaatagctccccaggaaattccatgttggtctgtatttgattccccagccgcttgggatgcaaatgcatgccattgactgtaataagaattggatgtatgtctataggtagactgtaaaattttaaagtttgatttgtctcctcatatggagaaactgaatcctaggaaaatttagagacatttcctagatcacacatttcattaaggttagtgtgggttctctttctattatggggtgtggcatcagaaaaatgtggttttaaacactgggtcaactagtaatatgccttatataagtcatggcatagtctacttagtgatgccatgaataacccactgagcttcatattcttaactagcatattcttaacttatctatattctaagatagctgagaagatgaaaaaatatgtatataaaaattctggccccaacacgcattaaatgatggtaaagattataattgttgatctttttatgtaactaacctcctaaaattatctttctgcccttttctccctgattcattcttcacacagcttatggattaactatctatagcacaggtcttagtatgattctctttactttaaatattctcaatggcttcctatcatcaatgaaattatcttaaaatttctcaccctaaattgcaaagccctgcgtatcaggctgcagcccacctttccaaaaatcattttaactgtttttctgtaattacactattttcatgtctagctaaattggtttacattccacagacaattctccaaatttctaaaaccaaaattccatctcccctataagcgctttatttattcttccaaccagatgcaacatttcccacagaagtggggaagagaaaggaaaaagcacctactgaatatattttctgtgcagagttctttcttctgtgctgggcactttaaatttgttatttcattagtgcttctcttatgacatgttatcttttgttataacaaaagacatgtttgttgttgtccattaaagctgtccattaagggcagaaataatgtcttaatctctagcatagaatatttacaagtagaaggacttagggggaaaatgcaaactgaacaccttaaattattatcaataaaagcactagccagaatgaggagttgaggggcatttgaagcaacttggaaaaccatggcagcttatttggggtagaaaggccctcttttatccatcataaatcatcatcagatttatactttgttagcaaaagggggctgaagtacaacatgtcatatagtgtgttgcaattgtaacagggcctcactcttctttcttcttcccaaggcctaatcagttacataaaaaaagaaagaagagaggagacgagagaagaaaagagaagacaagagaagagaagagaagagaagagaagagaagagaaaagaaaggaaaagaaaagaaaacaaaagaaaggaaattaccacgaaaccagtcctggaaaatgtaaaatgttacttgcatcatcatgtgaaaaagctcaaaagatggaaaaatattttctaagtacatttatttggacataacataagtatcttccaacatattttagcgatggaagatgtggtgaattgaaaagatgagttcagctctacatatgctttatggtcacaagttgccacttttaaaacatttatatactcttatgcatatcatataactgaacatgaatgttagcatctaagtatatgtatctgatgaaaatgccagagttataaaatcttttttatgtttttttaatcacaaaaatatcaaaatgcaccttggttttagggaataattttctatcactggtcctgagaacctctaaaattatggaacaatcgttccagactctcaataccattaagttcaatgaactataaactccagggcaaagaacacagcttttttgatcaacaatgtatatttaacgtccaagcttaatgactgaagaaagtaaactccctaaaaacataagtttttttttaatgaatcaaaagaaaaggaaaaagaaaaagatatttagaaaggacccatagtttgtcatctgaatgcagcagacatttaaaatggactctatcttttcaagaatatgaaatctactgacccctttcaaggggttcccccacctttcattgcctccctcagcagaggggttgctggatgccattactcagggaaacagttttgattccttcctgatcgcctattatctctcttgttttattgaaccagggtctctctgcaccctggcagaagctggcaattcatcaggataccatttagggaatcactgtgatgcttagtttacagtccacaaggcagctactgggagaatctggatcaatgtgttttatgcctctgaaatttgggcagcaaagaaagagtgcttcagttataaacatgcaatgtccatagttctcatcatccttctgaacaagcagaagctccccttttctgaacccaaatggagcaatccaattacaaagtcattaaatcccgttataaggtggttcataggagttcctgtttccagcaaaagccttttctgtgttcatccaacatatattctggcctcttgcactcagtttacaaggtttctaattaagctccagagaggatgatatagttcactgaactgagtcactatgctacaactgggaaagaagaggcattcctattttatcagaaaaataaacactttagtttcatttcctctgccacacatgttatctctttgtgctgtcacaacattttttataggtttttatttcaaaggattaccttgagattactgtcaacgcaagccagagagacatctccatacagaatataggggtaatattttttctcctaaaacatcctgctacagacaatataatatcatataatatcaccgaaataatctcccctattgagagcaaagagacagttttcaatagtactttggtacaaaatttgaggaaaataaaatgtttatcagtgacaaaaatacaatttaccagcttgatttttaagtcaaaaatttaaccttttaaacgatttcagaagctccgctaatttctactgttccttgtaacatctgtaggcaaaatacaacatgctgggtcataattcatagcttggcaagaaaatgttgcttaaaaacataaaggtccttttctttttatgcagaggaaaacattttagttattattcaactcaagtaaatgctcataaccatggaattaaatatttctgaagggttcattcctgagctttcttctgggttgaattaggctttctcagaactatacttcatgtcacccacatgtcttaagaactggtgccttctgctcagctgtgcatttttttgcagacatgccggatatctacgcagtaagtgctctgaaacttcaaagagacacagagcattctgtgctttctcttcccaccattccatgtaaacaccatgaataaccagaccattcttatgccaaaaggccctgatggcttgactttttggtccgttaattgttcacaatcactccttgcctgtattgtgcttggtaggaccacctttctgcagccaaaatccagccacttaccactgcatatacttcctacagcagaatagatactgaccaaagcctagtagaaacctgcatggcatcctgtctcttaatacttaatgctaccatgccctcagagtattcttattcagaatctaaacaagcatgtattcagaggctacaatgtatcaggcattggtggtgttagcagtcatagttcagtgaatgggaagaaagataaaaatccatgcctcccagtgactttaagtcctggtagggacaaatacagaagataagtaaataaacaagataactgtagatagtaataggctctgtaggcaataaacctcaggataatgtgatagagaatgacttggggattggtaatacccagatggggagctggaacaccgtccagggcagatggcatttgaactgaaacctgaaggaaaaaagaatctggacagcctcaacaccagatcaaacagtttttgaaacatagaaaacaagaacaaagcccccagtgggtgagaggaactgaagaagcctagtaggatggaagtataatgatactcatacactggagaatattgctaagcgcaaacaattctaagcttgtgaaagttccttgtgattattctatatttctttgaatcatattgatgaaaaattctttgtaataattcccatccaaatgtgacttcttgggtgcaaacataattttcacaacttatttaaaagcctatttaactttgcctatagcatgcttcacagaaatagtaacatccatcttacaggactttcatgaagactactatgtacggcagtcctcacttttttcctgctcaaaatcctgtctccctttccttttaaaagaacacagactttgttcgtgaccataatgtgttctccttaaaactacatgcatgcatgcattcctacacatatacccacaacctcaccactgcttgcagctagtgagttggcaagtatggcacacatagcacagagatactaatgagatgtgaatagaagatagatcttaaactcacgcattgtatttccctttactgttccctgtctggaaaatgaatgtgatgctaaaagaaaggcagccttctgtgaccctgaggtagctatgagaagttgcatatttggaatagttgaatggacagcttacaggagctgtgttctacatagatacatagttgtatgtagccaaatgcagaattatatgtaaagtgccacaaaacaaatgtaaggtaaatagtagtgtaaggccttcattatcatttatattactggtgtgttttaatgaagcattgaatttatttacagaaaaggatgctaagctgagatattttaaagtcaagctatataagaatttgaagggatatttaatataatatctgcttttccaccagccatcaatctcagcaaactcacacaggaccagaaaaccaaacactgcatgttctcactcataagtgggagttgaacaatgagaacacatggacacagggaagggaacatcacacagtggggactgttgcagggtgtgggggcaaggggagggaaagcattaggacaaatatctaatgcatgtggggcttaaaacctagatgacatgttcataggtgaagcaaaccactatggcacaagtatacctatgtaacaaacctgcacgttctgcatatgtatcccagaacttaaagtaaaatttaaaaaacaaataaataaaaataaaataaattaaaaaaaaatctttttaaaaagtaacacacctagtagctatttacttccataactattgtattttcttgccgtgccaaaatatctggcattgtaagaatgcacaattaaatatcattcatttactgacctagtatattgccagcaaagaacatgaagacatattctgctattgtttttctttctaccactgatggtggcaccaggcatttctcctatattccaaataaataatagaaaatacctttgcagccatatgagcgtttggaaattatcctagcaatctggcaagagcaaggaggttgacctggcctgcaatgatacgaacttaggggctccttgtggcctaaacttgtaccaggacaattctgagatcaacgttaccactgtcaatgagatagaagtcttctacacaaacaaatgtctgctgctcaaaggcctagtcagtgtacaccatctcccataagaaacttcccacaggaatctttagtaaacaactaaacagcactatccacaataagcagttgttatttattaatgacctattatttcaccaaacttatagtattaaaattgtaattagtagttgctatccattaagtacctatgagcctagcaccatacaatacagtatacattgtccttaatcttcatattacttaataatatgattaataatccccaaaatatgtaaaattaattgaattagcatacataggaaaaattcaaatgcattctaaaatttctttattaaaataagctagataactatgtggtcaaaatgctgtcatctattacctacgttgacttattgatgaatgtgtgtagatactttgtcactgggtcacttatgtcttgctgcttatccatgtctgcagaattttgcagagttcttccaggaaccgccaggctttctcaggataagatatatcagatgcattcagtgtgatcagacacattggggtacatttcacccagaggtgtacctgctgtttgtaatgctgctcaggatttgtgcctacaaacatgggaattctgataaattctatcttacacaattcccataaaaatatatgttgtgggattatggttacacttatacttttcaggtatattcctaataggagagacccatcattttgactaggcatctacaaaaacttaactctacccctgtcccttacaatttttcatgtttaatgtttagaagagttttcaacagaccatcttctagctccagatatttcaccttttctctgccactacccaagtatttttctatttctttaattttttaaattaaactttttttaagtaaatcatagatccacatgcaattgtaagaaataatatagagagacccatttcttccatatggcaacgtctggcaaaactattctataacatcgcaaccaggatattgatgttgatacagtcaagattcaaagtaccaccatcaccacaaagaccccttatggtgtccttcttccctcctgccagacccacttccctcctgcccccacctcctccttaaccctggcaaccaccaacatgttctctatttctatgtttttattttttcaaagattttatataaatgaaatcatacaatgtgcaacttttggtgactgcctattttcagtcacctgaattttctggagcttcatccaggctgctgtgtatatgaataatttgttcctttttattactgagtagtattccatggtatgaaaataccgcccaactatttttattgccaaactctgtagttcacattcatatcacaacatgacctccaccccagcaccttcatgacatgatgccaagtaagtcaacttagtgggcaaaaggaatgttccttacaggtattcaaattcagtttagcaatgcccgaattatatttggaagtttttaaacattccaaacttcatctccaactcaactttctcttagtaaaatgcaaaagttaactaatttttaaaagaaagaaaagaaaaagaaaaaattatgttgccactccaatcctgcctgatatgaagggaagtatggcagaggggaatacagcgtggaaagagacagtggtctcacacaattatggttaaaatattttacacttataaattatgtagcagtctgtgctcagatgaatacatggctagggcctcttttaggaatcttgaaagaggtcagaggaagcatgggacctggagcatagggctctttagaataaacctgcttcaactttcaaattgcctatatgttaacaggatctctcttgttaactggagaagctgccatgcttatctcaccaggcacaaaaatgcttccagccaagtcttcacaattgccctgaacaggtaaaatgaaagatacccacacttgaggctgatgccccagaatacaaattattaatgggtacaagacctattaatgacttgagtctgtagagagcacccagaaaaagaaagagctcttgatgtctcacataaaaagacgttttaattattgaacatttagtggcaggggtgagggaaggggagtgtgggagggcccaggtggaaagcagaaattttcctctacgactctctagcaacagcaactgccaatgacaacagcagctatgtgttgaacatttgttctgtgctagtactgtcaattcatttaagtcataaaacaattctttgaggcaagtactttattatgtccatgtttaaaagtcagacttattaaggtataatttatttatcctttttactgcaagcctcgaaatcaggtagtgtaattttgctaggtttgtaattctttctcaaaattattggtcagtcttggcctttagcttttccatataaaatgttatatcatcttatgagttttactaaaaagccttctgaaattttgactattgtcgcattgaatctttgatgaatttgggaataagtgatatcctaaaaatattgaatcttcttaaccatgaatatagtatatgtctccatttatttgggtctttaatttgtctcagcaacattttgacatttttatcaaacaaatcttacagatacattgttagatgtatatctaaacctctcatgactttgataatatttaaatgatatctccaattttcaattgtttactgctaacaattgatttttatattgatttgtttactgtgaccttgctaacctcattttattagtcctagtagatatttttgtaaattccttgagattttctatagaaagaattatcctgtttgtgaatagagacacattcatttatttatttttgatctgtatgtcatttatttatttctcttgttataatttacttggtataacctccagtgcaatgttggaaagaagtagtgagagtaaacacccttaccttatgcctgaccttgggaggaaggtattcattctgtcttttactattaaatctaatattagctgtggactttttgtagatatcctacatcagattgagggagtttcctactattcctagtttgctgagagttttatagttgaaaactattttcaatagttgcataattcattgttaactagaatatggtctatgttggtgagtgtttcatgtgtacataagaattatgtgtttcctgcaactgttaggtggagtgctttctaaatgttaagtagattcatattatcaagtaggttagtgttattagaatctgttatccaggtcctctatattcttactaaaattttgtctactgattccatcagtcaattagatagcaaagttaaaatatccaaccataattgggatatatctatttctcttttatgttttatcagatttttgctttccatattttgaagcactgttatgaagtgcatacaaatttacaaattattattttttcttggtgaattcgcttctttatgttatatgtctctttacttctgaaattattgattagctattacaatatatttttcactctttttctttcaacccatctatgttgttatattttaaggttttgttttatagacagcatatgatgtatttctgctttttgattctatcttaatatctatggtttttaaccctttattatattgctatttgttttatttttcctttgtctaatctgttctttttagtttttctctgttttcttctgctgtattttattttatgactccatcttattcccactttggtttattaggtaaacatctttattttttcaatttttttaatgattactgtaccgtctaaattatatttttaaaatttatccagtctatcttcaaatgatatttctccactttagataccattagaaaccctgaaacagtatacttttatttcatccagtccattctttatgaagttgctgtaatgcatttcatatctatataagtgataaaccccatattgaatgttgatattttttcttaagtttttcatttttttattaaaacagttcaaaattaaatcaaattcttttgtatttatcttcatttttaccacttttagaactctgtatgtcttatgcagatcaaaagtttcacctagtattatactcttgcttgaagaacttactttgacaatgcttatagtacaggtctacaggcaatgagtcctctcagatttgttttgtttattttttgtctttatttttataaagatatttttactggatagcaaattctgaattggcaggtttttcccctccaagtactttaaagttgtaactccattgtattttaatttgcatgatttctgcaaaaatatttgctattgttcttagttttgttaccttatgtataatgtgttttgttgtttttccttttgactgccataacattttctctttgttttggtttgcagtagtgtaagtgtaatgtgactaggtatattctattttatctatctatctatctatctatctatctatctatcatcaactgatcaattgattgatctatacttatactgcttgggatcacctgggcttctggaattgaaaatttgttgactttcattattttagaaaattcttacctagtctcttcaaaatttattctgccaagtttctctctcttcttgtctaggactccaattacacacatattagactatttgacattgcttcatagcagctggatgcaccattatgttttcttctctttatgtttccattgatatatcttctagtcaactgagtctattctctgctctgtccagtttgctcatacacccactgaaggaattttttatttgtgacattttatttttttattttgaccctttgcacatgacacatatttcatatagttttcatctctgctgaaattactcatttgcttacatatgtataacatctatccacgaaatcctttaaaatattaaacatagtttatttaacgtttctatctgataatgatgtctggatcatctataaatctggttttgctggctactttataccttgacagtaggttgcttctccctcaatatctctttctctctctctctctctctccccacccctgaccaatgagtatgtgtgtatcttgtaatttttggtttattgctgaacattgtgtttaaaataatatagactgaggtaaacagtctttatcctggaaaacaggcatgccttttattttctcatgccattcatatgcatgtcatgttgggaaggtttagtcagtctaatcagtttttgagcttggtttgtgttttgttattgccatggtaaccttcattccagcaataacttcacattccactagcatttcactgtcgataccttgtgcttaattggattttgtcataggaggattttcccctgtgttcttgctctattctcaatttttaacagtccttgtatgcttatgccatttaggagtatctctttatactattgttctgtcttaattattattttgcacattgttcaaggtgtgatgggtaaagtgggtagttttctattatcttgacccagcctcacacttacgtaagtcctgggtgtctagaccttgagaatggagctctctcagtgttcctgcccatcctcatggtagccaaatgtttcccttatttctgtaggaaggtgggggagctgggtgggagagaatactgttatttccccctgtgcattgtatcatctcaaaatcctgggtcctagcagtgttttttcctctctctcaaggaatatagattttgttttcattcctcttttggttccaatttacccctgcctatttctattggcaggggttttcttagcacttctgcagtagtacactgctattgcttattactcagtacaaaccttctggttggaacaggcagcttttgcttctattccttcctcctttccttttcctgggactggaagtagttgagtttttaactcctcctccagaagcaaactactttgcttttaccttctcccacaggcagtagttctttgccagggtgctaggagaagaaggagttacccaccccttttctgggatcagaaaaagggagacaaccagtattcatttgagagaaatatgaagatgcaccattgagggtgttcacttagttttcctccccttccctgaatactttctgtgggcacaagtagggcctgtaaatttaaaaaatacttagaaagtacagacttcacacatatctgaagtcctggggattctactctatcatattaactttacacttggccttttaaaacgtgttaaaaattttggctattttctccttactggctgtaattgacagtcacctctttctttcataatcttccaaaggtgaaatggtttatttgactaatctctttttggagggagtttctcagcctttgaaaataagattctgtgattagaagccttgtctctttattttttatttttatttttttttgagacggagtctcactctgtcacccagtctggaatgcagtggcacgatctcggctcactgcaagctccgccttccaggttcatgccattctcctgcctcagcctcccaagtagctgggactacaggtgcccgccaccacgcccagctacttttttgtatttttagtagaggcagggtttcaccgtgttagccaggatggtcccgatctcctgacctcgtgatctgcctgccttggcctctcaaagcgctgggaatacaggcgtgagccactgcgcccagccgtctctttaaaagagtaatgttttcacagattttgttgttatttttgttggtagagtaaaatgacattctcttgcagctttctacatttttagcgaaaagggagacaaccagtatcattttatatgagaaatatgagacttggagaggccaagtaacttgccgtgtatcgtaatctattaaatgttaaggccaacatttaagctcagatttttctgaaataaaagcctattgtcttaaacatcacactgcaatatatcttgtgtaatcttctcatcaaaagtacgtatttgaggtgtctaattaattctagtcagacccaactgttttcctttttattccaaatgagcactggaagcaatgttaaaactattcaacgagtcaatacattttctatcctaagtgcatctagagtacaagattttttttcttcttcaggtgagtatgcctagaaaatctaagcccttctctgatacctcagccattttggaaagtaaatgctcagcacttttgccattattaaataggcttgggtaactctaaaaatttctactagcgctgccttgtaaaaatgcacaggcaagcccaatgaggacatcatgtgatcacaggagcttgagcttaaaaagagaggacagcttcagggaagaagaattctgcatcaaattggggaaggcaatggagaggcaactcggaacagatggcacaacagaaagtagcttagtaggaactgatattgttaccagagaaagtatcaaaatcaaaggcagaggcaaagatagaagctagagcacagagaatggtcaagaaaggaggacagaattaggcttttgaaagaggtggaaaagtggtttggaagagatctacaaatgtaaaatatatccttctagtcacctgcagaagccatcctggtagttaggaacctgtgagagtctgatatgcagccagatggccctcacaccttggccagacatgtgtttatacagtaaattctatctcataaaccactttctcatgttatcttatttgaaattcatggcaatcctatgtagcagggacagaagatattgttagttccatttaccagatgaaaaccctgaaacagaatgttcataattcatcagattttccaaccatacctgcactcatagatcatgacataaacaacaatgctattttttcatcagtctgatcatgcatatttatgtgtgtatatttacttccaaggtgtctacagagttgcacacactctctgaatgttgctaagatatataaatgtggttacttttaaaaatcacaagaaatccattaatgattcattccatttaacaaattacaacatgataaaagggaagaaatttaaaaggaagaattctctccaaagttcaagcaacaaattttcatgtgatgttgggaaaagcaaaatgttttacagcttttagaggcgtaaatcaaaaccttcccactaacacttacaaccattttgaggttttattaaagaaaaaaattatctgaaaattcattacttggatgataaataggactagaaagaaagaggaaaggcctgcatgtggtaagtggaaggcattgatgaatatttggaacattcttttcttaagcccctctataaactgttttcctacatcatctttaaactgcacagatgggttcatgaatctggctccctcactatagcaggacattcttacaggcagggtctggacggattcactttttatatcctaagtgcccagcagagttcctaaatgcagtaaatgttcactaatatttggtggataaaaaatggtgccatcacaaaacacacatatacacacaagtacatatactcacataatagtagcacccataccattccataaatgtatacacttttatatatacctaatccatatgtatgtatatgcacacatattttcatctatataatgggctatatatcattataaataatacagaatcatgtaggtgttgttgctatgtgagtatgtgtatactcatataaaagtatgtttcatgcacttgtgtgtatatgtatacatatatgtatatagtcattttatctttgaatttttcacattatattttaatctcaaataagctttagtgaaagtgagttataacaatgagaataactgattttagtcttgactaatgagaatctcaattaaaaatgtaagtctgaagcatagcatgtcaaatatacatatgtttatataatataaattattttggaggtccccgatacttttcattacctgatcacaattacaggtaattgaaagttattagaaactaagcataaagctgtgcactcccgacaccacaagacctccaacccactagtcagctaaaaccactttctgatatactctgcacaatgaccctggtggctgtcagctctttcctgctttcctgcttccctggaacctgacagggccccagtgatgatttacctatgtcatgttatgtagtccacagcttgactgaggtcttgttctgattcacagcggagtgttgaacaaagtctgtctggaataaactgaatgcattcaggaaaatttccttctcgttcattcatttatttcctcattctcaaacattgagcatctgcaatgttacagatactgcattaaacactcgggtcacaaaagtgaatgaggcacagtccctgtctaactgctgctgaggtttccacagtgacattttcttaaaccccaacttatacagggtgttttcagagtgggattgtacatgttccaaacccaagtgattttgtttaataattttgaccatcaaaaatccagtttgaaaaatgaaccagaatacaaatatacaacatttaatgacagagaaaaaataaaggcatacagttttttaaagaaatatttcatcctttgaagaatactgagaaatctgagttcaaaggtgatgtgagcatgcttcaatcatgactatacacaacagaatctgtactcagctcagtattggctagagaagttctctttccctcatttaagccaagaccagaactccaaggctgaggcttgacataggtgtactgtaaatgaagtgttaatgagatggaaattctccaagttgcttttgagtctcactctatatcagtgtagacctgcctaaaatatgtaagagctgagaatccttttgaaatgattccaaactcttgagtctgaaaaccgagctgggaattcctttgtaacagttttgtgggttattttggcactttggtttataatcctagctggaccccatctgaagttctaaagcccataaaataagaatgaatggacaatgtaaataagccaaatttgagaaacttcagaccctgcttggctgaatgtttctgttaatctaccttgtctgtgctggtagaactgccattttgctataactcctttgtaaataagaaacttttcttctcatcaggcaggggatctttctcttcaaaggctgtgatgtattatactatattgaaattaaattgtttggatatgttttgctgaatactgataaaactatgatataaagcgtattatccttaatcaaaggttacttttatttgcagattttaaaggcaacaaaaatttttatttgacaggttctaatagttctagtttggcatacctgcacatttttattgtatcctgggaacaggcataaatcaactgatttcccacagacaaataaaagtggtggagtaatatagttcctggaatttaacacttcatggtcaggaggtcacatatgctaagttgcttatttacacgcctcttaaagtttaagtctgtgggcaagagacatgaagcaatgtgacttactatatcaatgaagaatgtattgttctttttcttcgggtagataaaattaacagtgttggaacagcagatcacacaagaatgtcatcagaaacatcagccattttttcaaatgtgcttgcttgatgattctctttgttattacaatcatcagttttaaacaatgagatttattaaacatttttttaagtggggaagagagagttagtgtgtaccaatcattgacatattagctggcatctcgaagcctaaacttgcagttaggccaatgtagccagaatggaggtgatgcagcaacccaggtgcctcctccggccctcacttttgctgccaaaactgatcttacagcccacatgttacagatggtgactgtaaactggagagatagccatttgacccacatttaactatgatacaagataagcgatagttattttcacagctttccatataaaggattttgatgagaacaaagttatatacaaacaaagttcatttacgcaacacaattgtattgagatcccagtatgtaactagtactaaacacttcttatacattattcccttttcacatgctcacccatttaaaatttcacagcattcttcagatcagtatattaaggcttagaaaagttttgacttgctaaagacacatagttagaaatcaaatgagtcaagatttgaatccatatctccctgctcagcatctacacttttcttcgctggagagtacattggaagcctaagctgatcacattccattaaacctcaagtcattttgagcccaaggcttcagtttcttcctttagaaatatatctcccttcaaatatacctggaatttacaggtgaaacactggcaaattaataaaggaaattacatcagtgccctaagaaaggcaggccaagagtgctggtaggaaccatagaagcaagaaaacccctgcagctttatcagagtccacatgcagttacttattgcagcatttaaagccttaaacccttgtcccttacctggtggcctcactggatccagcaacaaggaaggaggctgggcatggtggctcacgcctacaatcccagcactttgggaggccgaggtaggcggatcatctgaggtcaggagttcaagaccagcctggccaacatggtgaaactccatctctactaaaaatacaaaaattagctgggcatggtggcacatggctgtaattccagctacttgggaggctgaggcaggagaatcacttgaacccgggtggcacaggttgcagtgagctgcgatcacaccatggcactccagactgggcaataaaatgagattccatctcaaaaaaacagcaacaaaaaaaagccagcatggtacgcctgtaatcccagcactttgggaggcctaggcaggcggatcacctgaggtcagcagttcgagaccagcctggccaacatggcgaaaccctgtctctactaatgatacaaaaatcagccgagcatggtggtggcacgtgcccgtcatcccagctactgggttgggaggctgaggtaggagaatcgcttgaacccaggaggcagaggttgcagtgagccgagatcacgccaaggaaggaggtagaaggaagggttttcttccttccatattaaggaggccaactgcattgccaggactctcccggaggcaaactgaaaaatgaagctctttctgtttttctatgcaaatcgcaatgctgaactttctgagacctggcataatgcagtcacatgtcttgtttttgcattcagaatattgtcttttcatagtctttcagaatatgttaaggaggtttcactatatatcacaaatcatggtttaaatttcaaagcattagataaaaatgaccttacactgcatttgtagatgtcactctcaagccatcccaatgtagtttccatgggaactaatgtacatcaaagaagaaagagagagaaagagagactgtaagatcaaatttttagttcctgcctcctctttttctgggaaaaccaaaatgagccccatgttaaatgctgttgaaattagatactgaatcttatcttctatgtgaatgcagctttttgtttttttcctcctaagaaggagtactacctatatggtcatgcacaatttttccatagagtccatccatataatttataagttgtatttacagcctcagaaggcacatgtgcttatttaggaggagagtcaacatcatccattattactttgttttcaagttgctttcagaattattattattacacagatttacaacttgttgagaatccactctatggcaaccatgagtgaaagtggttcgtgaatgaaagtttatagtcacgtaagaacacattcctagattgtcctctgttggtgtagtgtctttcatagtcatatgccagacagtgtaacatgagtagctgtcattagcttcccatccaaaaagaacagttaccaaacagtattgttaaaaagagcatgttacagctattattctttttttcttttttttgagacagagtcttgctctgtcgcccaggctacagtgcagtggtgccacctcggctcactgcaagctccgcctcccgggttcaagcgattctcctgcctcagcctcctgagtagctgggactacagtcacgtgccaccacgcctggctaatgttttgtatttttagtagaaatggggtttcacagaattagtcaggatgctctcaatctcctgaccttatgatccacccacctcagccttccaaagtgctgggattacaggagtgagccaccgcgcccagcacagctattattcttaaatccaatgccacatatcaaggccaactttatctacctctgtctcataggactcacctgggttataaaataaattcaatactttaatcggggggtggttggagagagacaatgatatattatattctcaattataattgagaatggtgatataaaatgtatttgtagcctgtagataattaactagaaaaacaggtgatcatgtggtttaaaataacaattaatttaagaacttaaaataaatgtttttaaaaagatatataatagtattatatgtcttaataattatatttattaaatataataaatattactattatactatatttacaatagtatatactattatatttatatttataaatatgttatataatagttatatttatattatatattatattacataataatatataaatataaatataataactatattataaatataatagttataaagacaatatgacaaataaatattaaccatttaatttatatcagtcactaccctaaggattgttcttttatctaatacattttattctaataactctgttaattaggaattcatgttcccatctaacagattaagacattgaaggacaagaaggtcaaataaagggctgaaaaaaatctcgtaacttctaagtgaaccaggcagtttccaaaacctgcctcttagctattatgctataaatatttgagaaaagtatttacattgacaaataactatgaagtttttagaacttatgaagatcatggtgaagaaaaaactatttgtaacattaattatcaaattgtttattcctttctgaaatcatttattcaatatcatttatttgcagataataggtaccaggcattgagaaattcagaatgaataagaaaatggaataaacaaagggttataaaaaaatctaggatgggttattcattttaaaagagaatggagcttaggtaaaaaaaagcaaaaatatacacaaggccttgaacattctaacataatgagcaagtcataccctgccagatccatgagagtggatgacaggatgtgctggaaaggaacatgggaagtacctaaaatgaaaaggacctgaaatgtaattctaaagatttcgtctaaaagaaatggcaagttggcagataatttttaaattcaagtgtaaataatctgataagtattttagaaagctgactggatggtataaagagggtggattagagaaggaaaatatgggtggcagggagatctatgagggttttgtgatgggttgaatggtgtcctcccaggagatatgttgaagccctatttttggtacctgtgaatatgacttcatttggaaataggatctttgcagatgaaatctagttaagatgggttcattaaggtgggccctaattcaatatgactgttttccttataaaaaaaggaaaagacggagaaacagggagaagaatgccacataacaatgaaggtagagaatggggttacacagctacagaccagagaacatgaaggactgtcaccaacaccactgctaagagaagggcacagaacagattctcccgcagagcctttagaggaagcaagaccctgtcaacagcttttctgagttctagccttcagaactgtgagagaataaatttcagcttatggtactttttatatgacagcccaaggaaactaacacaagtattggtggaacacttcttcaacaaatagcacttgaattaaggcagcggcactaaaaatggagaggaggaggtatgtggtagaccagggatatatttgctaaaggacaaacgaagtaatgagacttagaaacagaatgatggagccacaaagaatgcctgaaatggtaataggatacatgcttgaatgttgatgggccccatttccacaagcctccaaatctgcttctagatcccattcgagcaagggaggatttgttaagaagaaaggccttttgagagcaccagtccctccaccagccagtctagtcctaagagctctgaaggccaaccttggaagtggtttaggagggaaaatgtaggacccaggatttcagttgccaagccggagagcaggggacccaggaaagaatattggcattcacttgatttttccatcttctgatataaccttcaaatgttaatagtgtgtcgaagaatttattggaagtgagaaacaagaaaacagtgagtctaacctagtcattctagaattgggaggtaatagaaaagagagaaatgggaaagttgctcaaatgcaagtccagtgaatcagagagaaaaggctcaaagcagcagaacaaagcttcaataaagagatattgtgacttggagagatggccttttgtcctttgttctattaccggtcagagaatggggagcacacccaagcctgagacaacagctctgctaagtgcccttgagagggcacggtggggtcagcaccaaagccagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaattaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccctcagactgtgtgttctgtgacatcaaagactggcaacattctaaaggtaaatgtaactatgcatccctttgggattttcagatatcttgtacaatctattttattcctctaaacatggagactataaagctgtgtggaaatcaatagtttaattcattcattcaacaaacaggtggtgagtgctcatcataacaaccacatctaatagctaacatgttgaatgattatcacacatcaactactatgcgaagtgcttttcatggtttatgtcatttaagtatcacaaataatactatgagataggtgctcttgttatgtccacttgacagatgaagaaactgaggcccaagtcccagtcctaagatgaggcagagctatgttagaattcaggtaatattactcaggaggccatgtattaaacctctttataacatatccctgtatcatatctgcattaggcatagaagactcaagggttatagggtttcagagaagggaagggctgaagggagttaattaggacaggctttaggcaaaaggtgatacatgatgttagctttgaagaagaggcagatttgagtcagcagagcgtgaaatcaaaggctcccaggtaaggaatgggaaagcacgtgagtgtagtccaaagtcaacataagacaaaaggcattgtagataatgaggggacaatttcgaccagaatggtgaccctatgagcagtaaaataagtccgagaagattgagttagccattggagagaagtgtctgacatgttggtgttggaaaatagaaaatcttggtggttttcttagtctaagcagtgttgaaggtaacagcagtggtacacaggatgaattacactaatagaaagcctggcacccaaggatttcagctagggtttgtagaaagatagaattatatgagatgtgttctaaagcaaaagtgataggacttgttctctgtgacatattgaaataaagtatatgaactgattataccaacaataactaactttattgagcatatactgtgtcctatagtggtttacatgtaatcatagattaattctcataatagcaccacgatttagaattaaaggaaggcccgttctaatcctaggatttctttcgttatctattgaagacaatgaaaacagtaattctttaaataatgttgtgttatgggggtattatgataccattgacaggagtgaaatagtttggaagtttaggagcagaaaaggacaattttgactgaaggcaagtaaaccaatcaggggcagtgtaactcattaggtcgtcataataataactattgttattattatttattttgattcgactatgaatcaagatgtcctgcagataccaaaatcagtggctgctcaagtccctgatataaagtagcctgccttgactacccttctttttataattataattattattacagctaattactgcatgcttattatgtaccaatgttctaaacatttcacatgccatagctcagttaagatagtaataattatagtgttcactattacaataataagagtttatatttacagtgctgatagtgttccaggcactgatatgtttttaaatagattaactcatttaatcatcacaaaacccacatgaagtagatactaatattctaccttcactttacagatgaggacactctggtccagagaatttaagtaacttaaccaagatcacaaaactaatgattggcagtgtcaggattgagcccagattctctggctgtagattctattctcttaacaactgctctacaaaatcatgagctttggggtcaggcaggtctgggttgcaatcccaaccttgttaacttactactagtgagaacttcggtatgctccttttttgtgtctaagtctcagttttcccataagcaaatttcaagataagataacaatagtacttttcatgcaataattcctatgagattaagctctcctacccttctctgtgcttattacattgcttcaaaacaggaagtcttcggtgtgtgttttactaatgaatgaataaatgaataaagcacttatcatccatgctgcacaattaacattttgttgtatgctactttatattatttaacttttctgtgcatgtacttttcttgtcaatccagctagattatatgcaccctaggactaaaccacatgctttttactttaatatgtacccagttctctgaacagtgatgtgcacatagaaagcttctcaataacgatgactcccatgaatgaagcatttactatggcctagacattgtgttaagtatttagtcttcatagcgaccctagatagtaagtactaatgttaattccaatttacagaataggaaactatgccttagtgagctaaagtgattttccagtggccacaccattagtccatacagagtcagattagattgagctctacttatctacagaagtcctgggcttgatcaccatgctgtactagcttggtgttaaagccctgattgatgggtaatttgacaagaagtcagagcccattatcacctgcctttggaagggaatttcctgcatctgaagttcttgtctatttggcccacttggctcaaccacctagttcacggcttttctgtagatttctcctcttagcactccctcaacaggcacaaaccacatatccaagtcagggatgccataaacagtggctgctgctgtggctggcccacagagcatggaagcaggaatactcatgagccccctctgtcatctcagtatattatggcttcagcattctctttgcttaacaacctctggctgatccactgtgaaaattgtgtgcaatagtcttcaaaatttctaatttcatacctgtggtgaagtagccttgcggctggtcaaagagaacacctttaaagctgacagtggaaaaagccttggctcctaaccttctgcaaaactgtttttactacttcatgcaagctgttattggtgtctttatttaggctgtatttcttcatttcagcgtctatgtttagcagttatataaaggagcgaaatgggtttaatggcctcaagtggcaaagcagtgacatgtggtccttcttggagcaacaaaaggtcaaaagactgtggaggagacttcttgtttcctggtgactaggagtcaaatttcttttatctgtctgagtcaaggggaaatgatgttcctttgaaagtctcatcttgtaggtagagtgtaacagagtaggaaggtagggaaggttccttaaagggccatgcagataatctcatctgttgatttgtcctattgtgggtgatacagactcacattccctttctggagaagggagggttttaattaaaactaaatagatatccactgggtctgggtatgtacataatctagaaactgtgggcttctcaaggcctctgcattcagcatctcaagaagtcctatgggtaccaattgatccatcctggaatcactctcctctgcttgcatgggacttgcctttctgccctccttccttagcactcccaccaggctaggtatgagccccgagtaaggagccctggtctgattccagcttctttctcttattgactctgtgatttcaataagatatttgactttacaagttctgcgtcttcatctgaagacggagactataatgaaaatacaaaccttatggatttattgtgcagagtagaaggacaaagtatacaaaatgctttggataattgttatctaacatcaaaatttaggttcacatacctgatgcacagtaagccaaacactgacacatcagcataaatgtttattcaatttggccaaagtgagagggcaggaaagacagtctctaaagtccaaccttcctttacacataactgggggcttctatgagtcaggtaggtatacaggaaatgggataccccaaagaccaaagctgtttatgtctcttggcctgatcagacttctggatgccatcaaggtttgtgtgacctaaggttcatttttcttctccaaaaaaaatacagtttatcaatcttgcaggccaggggtgtaaggatatgaagttactagtgactaccttctaccaaaatgactatgtgcaagcaagcatgcatggaggcagaaaaaggcaaggaaaagagaaaactaagtaaaacaaacatcttatgattcttataataaagactcagttacacaataacgttgtgcacactaaaatcccaatgaatgggtgctgttagtataggcagctggcatatttttccctagaccaatcagtcttgtatttctgtttcaaggcagcctgcacagattctccaaagcaattctcagcttattcatagtagaatcaaaataatcaggtgaaagaaaaatttattcataaattcttaatcaaagcttccgctgtacccaccctgaagcagtatgagcactaaaaccatcctatttctttttattatactttaatttctagggtacatgtgcacaacatgcaggtttgttacatatgtatacatgtgccatgttggtgtgctgcacccattaactcgtcatttacattaggtatatctcctaatgctatccctcccccttcccccctcctcatgacaggccccgatgtgtgatgttccctttcctgtgtccaagtgttctcgttgtttaattctcacctataagtgagaacatgcggtgtttggttttttgtccctgcgatagtttgctgagaatgatggtaaaaccagcttatttttaccatctattaaatgggacaaaaacttcaatacttctacagttgttgtatacaattaaataatcttctaaatccgattgtccctccttctcttcttctcctttgataaacaacacacctctctgcatagagcaacagaacttccttttgattctggcccacaacttcctatgtacacctcgtttgtaaagaagctcatctaaagtcaaccagcaaacgatgggccctccaactctgatagcctgtcaccagccctaagctgccaggcttcctttgagtgtctgtcattggtgagatatagggacgtgtgaccattttgccatggctctatgttgctgaaccaggtgggggtgtgagtggcagtggggcaagtggatccttttgatcattagttatttttgagtattgactttaatttgtaaaatttcccatcttaatctctgccctagtctctaagcagatcccagggcattgaggagagttcaggtatgccagcatgttttggtgtttttccaatgccaaaataatattttgcccactgaattcacaagtgttttagatggtcatccagtttttgtattgacccctcctaaagaggtaacagttatcccttggtatcaatcaaggcatggttccaggacctcccttggataccaaaatccatggttgctcaagtccccaacataaaaaaggtgtagtatttgcatataacctacacacctgtgtgtatatttgcatataacctgtgtgtaggttctcccctttcctttaaatcatctctagattacttttaatcctaatacaatgtaatttccatgtaaatatctgttacactgtattgtttatggaataatgataagaaacaagaagtctatacatgttcatatagatgcaaaatttttgaatattttcaagccatggttgtttgaacctgtcatgtggaaccaagggatacagagggctgactatattttaaaaaatgaaagaatattctttgaccacagcagggggctactggcatttggggatggggacaaaaatgttaaatactttgcaataagaacattaacacacagtgaaaattgtcatgtcaatgctcccttcgttgggaaagctgcaattagttataccttttctctctcctattagagaaatcaaccaagccaagcctgagtatctcagaatcagcatccttcagactcaaatttgagtcctgactactcaacatctataagcgttaagcacttactttgtcattcaatactcgtttaatctcctaaaagaacggcaagcttcttattattgcccctactagtggaaaaaataaagccagagaaagcaaagattctaacactgagcccagcacaagtctaccaccttatgctgtttctatgacgttaactttatagcatgatctggattgctaaaaatgttcaagtttgggccttataacaatagaaagaggactatataaaactacagtaagactaaaagtagctaaaacatattacaaaaataaaaaactggagtacctcgattatatacaaaagagcctttgaaaaatgtctaggtgaatttttgtctatgtacctatgttgacatcacaaaataacaactatcaattcaaaactcattccttctatatgtttttctcatatcgattttaatcaaaaggcttaacttgaatattaatctttcatgtcctccttatctatttgaccctctggaatactgctgagtaatgtggcattcacaagaatattactgtgtccacttaagtgatttaaaatgtattctcaatagccaaagtgtcctcctgactctttgaaattcagccatcctatgtttcagatggcctttcacttgggcttttaaaccactttacagacatctctttattctcctttattttataaattgggaaatagatcaaatagaagttaagtggcatatagaggtcaatggcagattactggaagacccagggaaaggtatcacccttgactcacctagagttatccctcagataatttaacatttcttcagaagactgaggtagcctctgaatgtaggaggcagactaaaagattattttttttcatgaggctgcctcaagcagattcacatttaattgtgattcaactggcatctcctttcttgctgccacaaaatatctatattgaaatcaggttgactgttcatcttttctttctgttacgtctgctagggatcaatagagataaaaatatttggagctttgtgttcaatctaagttcctgcatgcagttgcttgatagaatgattttgtaaggaagcaagtaaccaaagtatttttgcagtgtttttgataaaggactgctctttgctggtgtcctcctctccactactaattgacaaaacatcttgaggaaaacatccatatgtttaaattatccttaaaagctctattggcattaaaaaaagacctccgttttgataaagattccaataactatttggcttttgcaagtccagctttatgactagaaatttctagatcaagagtctgcaaacgatggtctagaaccaaatacaactgctgtctgtttttgtaagtaaggttttattcgaatacagtcttgcttgctcatttaaatattgtctaggctgctttcatgctacaatggcacagtggaatagctgggatagagactatatggcccgcaaagtctaaaatatttacaacttcactatttacataaaaatttgtcaacaactgttctacattaaacaatatatcagccctggcagatgtaactggttaccttgagtatctcatagcatgtatgcagtgtaattttcaagttcccaaacaaaactttccaaaagccatttcttaagaccacacactgtagagtcagatccaccaagttttgaattatctgaacagagctttgcaaatgtcaaaccagtatagtagatgatgacgattttgctgaaagatcactccactttcatcaggggaaacaagctattgggaatatattttaggacctcaattttccacacattgctctaattactagagtgctatagatgcatatctctgatttacagtccgccaagtcaagatttctgaatttcttggcataagtttggtagtacagtattactttgattatggcttcttatatctggcataaaaatattccctttgtgcatattctttttagatacagtacaaaaaaaagtatgactcttccttttttctctccctttactttaggaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataaggtaaggggaaaaatgtcaaaagtacatgaaaaaaatcatctctaagaaagagcaacaaatctgctagctcttaagaacttataattatcattgctggttaattggtattatagattacccagttctgacatgtaattttctaacacaaagaggtttctatcatgttacattgtgctttgcatttagggactttttattttacatttacacactaaagaacgaagggcagaagtcttgaaatatgcaaggatttagataatgaattgcatcctaaatttagaaaatatatcagacaatacagatgattcattgtagaatttgtaattctggaaaggcaagttttggggaccattgtttataaataagctaacttttattggctcagatctggataagtaccagaagcattaacgaacatttcttcagctgcacacggaccttcaaaaagttctaaaacagggtatgttattatgttttacaggaagatgtgtttaatatttgtaagtcaatatggataataacactgatttaaatggactgatagatgcatttgtcttttaatgtctattataataacaattgccaaaagcctatgaaaaattcaacatttacttgttgattagtctgtttttgattcatatatgcaattaattcttaagtgaagtttttcagagacactagcctctccttaaaaggcaaccatgttcacttgaaaatgtgaacagactatagatttgagattctggcttcacgctttgtcctgggaagcaaccttggatttggaatttaatggcttcctggctatctggactgtgaagaaatgcttctgaggggagacagatgtttgtctgaaactctattgtttaaagagctggactttgtctgtaacagcaggtatgaagatcagaaagaaagattgggagcccaaatgaaggcattagtactttgtaaacatagacctcatgccgcagtctgggtggattgatgataatgctacaaagaaaaatgcagcaaaggaaacttaggaatgaacctaaaagacacagtgtcttagtaaactaaaacgaaagtaaaaggagaccttcaaagcccactgcttgtaagatgagcttcttttttgaatattattccttaaaggacaccacacacacccaggtgaactcatggaatttgcattaaataattgataactttttgacatttatttgaagtttccttccaggaaaaaatggttcaagtagcactctggcattatttcataattaagcagccttttgcatgtaccatatgcaaccaccaaatctaaggtcctgtgttatgtagcctttccaacctttctaaatctcaagttttcagtaaatttaatgttttctttagagaaaaagacagtgagagacaggcagtgtccatttgaactagcaaatagtctgaccagatgacgagtctactagctcttctagtagctgctgcaaccagcaacttagtgggggcaacatcctcagccatgccacgtgggctttgcctgaagacaatagataacagccaagaggcagacaaagaaaatatgtgtaaaaacaatggtaaataaagtaaataaaattaacgaattagataaatgaataaaaataaagagcaaaagcaaatgtcaacatgcatcaattccccatccaaattacatacctcatgtaatttttgtaaacattttgtaagatttaccttcttgatttatcagcaatcattctggtttgcaataaaataatacctgtaagtggtttaattggaactgctgccactgcttgagatttatgaattggaatattacatgataatccacaggatcaccttgctttcctattgctgaagtttgcctcaattcttccttccattcattcatttactcaacaagcctccattgaaggtctgctataattcacataggggtccccctcccttaagaattgcaaattatacatgcaagagaaaatattgttttcactttttaaaaattatttcatttctatttttaaaaagagattgttttcagacagatgggctaccctgtacattttttactttgacaagtacattctgcaatgttttgtgggagaactgagtttatccttttgttaacttcaaaaggtcaggtatgtgcctcaatcctcatttgtttctattacaaacatcttaggaatccataaagttatataaactttcaaatactttgatatttgatgagcaaatctatgttcattctgttcataacctttatgacataccaaacaccaaccattttatctccaaattccacaaatgaaggggtcattatcacccaccaaaaagcggtttacaaagattttaacaatgtataaacaatcttgcttgaaactaatgaactcttacaatctttctgtctttttttaaaatttttgccattacttgttaaagaaagtgaccctattggatcgtgttttcacgtaataaattttctgcgaaatttactgtttagtccttggaggcatattactaaaaatcaaattggattttcttctgaaagaaggttacagagtgtgacttcatgagtggaagtatgttatggctaaagagcccatatttcatgctgtaatatagccaagttacattggtatatatattccttggccattgaaacaatgttaaacaatatttttcttttgtctaagatacagttagttaagctgtcattaaaaaataaacaaattgataatcagaaaaaaaaatcagagcaaagcaagctgtcaaaggttggctgtaaatccagcacaaggtaaaatgtggctattttaaaaagggcaacttcttcctaagataactgtttttttttttctctgcttaaaatagtcattgagggatattcaattgggaccagagaaaggggaagccagaatcattcatcaggcagatactttgtgtcagttataaacagtatatttcaaaattaagtatgagaaactccaggaggagattagacatgaggaaacaagctcagtaaagctaagaatcttgcctatagtcatctgtgcagtaagaatacactatgactattacagctaaaatatctttttaaatgccaggtattttctattctaattcttagaacaaattagagaactgagatttagagtggccccctcctctgcctaaaagcactccagatctggtcatttaatctctttggtatgccacttgtccccagggaaccaaactaacaagtttttcttctggtgtgctctttagcaaaaatgtagagtcatcagacattagtgtgtttgttgccagcttcgtgtgtgtgtgtgtgtgtgtgtgtgtgtgtgtgtccctctctcccctgcacttccaactgatttaactttccacttgtaggtgggtgtagctcagagaagatcaagaaatattgcactccctctactcaatattgtggaacaaattaaaacatgttcaatagttgtgtacctacaataggtaggagagctaggggctggggattcaaagatggcaaacacaatttatgctcctaagcaaatacacaagctcagcaatgggatagacaggatcaagtaagactgaatgtgctgtgctataatttgggcacagatcacatcctcttaatgcacaaagaaagaaagaactccaacaatgagaggagaatggatgggagggactgaggcaaacttcctgatgcctgtaacatttgaactgatctggaaggatgattataaaggattttaattgacaaaaacaatggtggaagagactgcatgagccagtgcaggaacattcttacattctaattatattcttatattctcatattctcacaggacattatctttaccaatgttaaatgattaaactaggtaataaacaaggcacacaatgatcaaaagaaaggggctctggggatgaacattctgcctttaatcactaatggtgtggcctaaactgtggggattaacaatgctctgtaatacccctaactatgcaatggggataagaagaacctctcctccacctgggcattctttattgttgtcttcataaagacttaggtgtatggaaaattgggcccagtgactgacatatgacaaagcacttgaaacatgattctatttttatcattattagttctaccaataataattatatacaattaatagaaataattcgcttccccaaaatcaagaagatagaattttaatataaaataaagttttaaactaaggatatttttcttcactagtagaatttttgactcagcatcagctggcaaaacgatttaggaaaattaaggaaatgttctagcatactccaaatcacatgatgtagttgcctacatattccaaaggctttcattctttgctcattggcatccatatttccacagaaaaggtttgcaagctcagggcatcatgctaatgtctaagacattccatcaccattaagggactttaaaattattcctagtgacaacaatatggttctttgtgttattaagtaaatcatggaataataagaacaggaagaacactatctcgttcactaaataaatgatcactatcattaaagagctattaaaccaaattctatcaggtatttttttaaagatgtgttcattctttctactcacttgctaaataagaaagaagaaaagctcaagagtctttaagcagaagctctgttctgcagctcacagaatggattaacaccagctggaaaaatctggggaaagtaggctaatccttgctaagttggtggccctatctagctgctgcagaagctgcagcatctgggactggcttttactcccaactggcttcacccttcccctataactcttatcctaatgttattcaaagagaattccatcatttgccctgatataagcatcaggcacacaaagtcaacccacagacactcctgcctatccctagaaattttgaaagctccagtatctgtttagcactagtaaatcatttcctgcttggtcaatccatattttactttgcgtatacagcctctacttttatccagttatatttaattaataaaaataattcctgtcttccaactataccaaggaaaatttcttcatcacaccattttagaacatttatttacaacatacggaaatacaattatatctttaagttaacaacttgtaactgagataagaaggcattgcttctctgagtttattttgttagagctgttcttttttttttttaaaggaagcttctgctcagaaaatgtgaaagaaataatctatctcaagaccttgctgttcttgactgttcaaaaattctttaaataaaatataatatggaagctgtgctctgcatgtcgagaccatttcactgttgagccttcacagccagaaaacaggctcaaaataattagacttgaacaaaatcacattatttactttttgctttaataaggaggtgattattagaagatgaaccatgactaccaagatagcaggtatagattctttttaacaaaattaatttagattatattcactatcttaagatacttatgcacataaatcatatctctctacgtatttttgcatgaaacatagagtatatgaaataaaatgaatgcaatgaatagaaatttaatcatatatttacctgaattattagattattcataaatagcttattagaggcagtaaaagtcgacagagaatgattgcaataggcagatgtgatgtaagtctgtgatattttagaagaaattttcctgtaaatcacacatgaaagatgcagccactcatgctggacaactgcctggtgttcccaagaaacatagggacaaccaaagggcacctcagtaagtttatactggaccatagataataaactcatcaacaaacaccagatttttgttctggagaaaaagatgaaagcttttgaacagtactagtcatcaccaaggaaactgtggtggagtaaaaaaattttaagaagatatcaacattgcagtaaatcaacctaacctggaaatgtgtttggtgacaaactgaattttcctaggtgtcggcaaactaactcttttaaggccccactaggggccttaagtgatctactccccaattcttccatagatgcacaaaaatactaactgatctattcattgtgtgtctttagaaatgcagacatttaatgggttacgaagcttaactgctagacacattcattagatgtgaacagttaatatgtagtcatttctgttggcttctaaaatatcctcatcactcttttgagacatagcagctcatcctaggccaatgatatcaaccatggctgtactgtgaactgtaatccagtatctttctctcaacacctcctctcttctcagctaagggtgttgtatattgaagatgctctgcttttccctctgactttcatcacttaaaactttgttgatttcacctgaggcaaattgacaaatatttttaatcatctttcacctttctttctcacttccaactcttctccaattgcctgactgaaatttctattccttttcctgtttttttcctacatatttcagaaatggccctgatttgagcagaaaatattaagaataatgctaataaaaacacattcatgttttcaaatgtaattaaattttaaaaaagttttatgctcaaacatttctagaaatatcctaaattacatttcagaagttttataaactatctcagctatttcttttcctcttgaagtgaatattttatcatcatacatattcaaaataaataaaatactatgttattcaattattatgttaccatactactgctgttttagttcattcagctataacaaaatatgacagactgggtggcttataaagaacagaaatttgttttacacagttctggaggctgggaaggtcaaggtcaaggcactggcagatttggtgtctggtgagggtccactttctggatcatatatagtgccttctccttgtgtcctcacatggtcaaaggggtgaggggtctctcttgagcaggttttataagagcactaatctcattcctgagggctctgaccccatgacctaattatctcccaaagtaaccaccttttaataccatccccttgagggttaggattttaacatatgaatttggtgaggacacaaacattcagaccatagcaattgcctttttctcataacatataaactctcaaactatattatatggtaattagactttagaaattagttttaaaaatctaactacaatgttcaaacaacgaattcactaggaaacttttagaaaataactgatttctaagttggagacatactatgtaactgtattaagtcacaaagctcaaattcagtttttctatttgacttcagtgtcaagattcttcacattttgctaggctacttactctccatgttcaagttatctctaatgactatatcgaaatagaacacagatgaaagcaaaaatagaaacacagatgaaagcaaaaatagaaattgaaccacaaacatgaaacaggtaacaaacagaaaatgtctctgagaaatgccttataattctaaaataaatttggaactagatttttgcagaatactgcttaagaaattaaattgtaaaacataagggaatcatttgaataagccattaataagattaatggaaaataatttattctcattttatctctagatgccatgtccagccaaataaatgagactgaacttcatggttgttgtttttacttcatcccggcaaaagaaatgaaattaaatataaaaagcagatgaccaaataaagtccaaatgaattaagtattgctcctagtataactcacagttaatataagttgactatcctctctgtagacaacacttttcatcaacatttttcaccatacagctagacctcaactaacagtcaagtgtcaaaaaaatgaatcactttagaaaccatcttaataatgagacaattgacttctggtacccaatttagaacatctacaaaaggagtggtgagcagatttccactctgatgcaaaatcttattcgttgggcattgatagctgagtgctgtgttaaggattctgaagtggtaaatcacaaagaatgctgtcaacacacttagtaaatagttaacacaggacttctctagtattaaaattcataatagtggccaggcgcagtggctcacacctgtaatcccagcactttgggaggccaaggtgggcagatcatgaggtcaggagatcgagaccatcctgactaacatggtaaaaccctgtctctactagtctctactaaaaatacaaaaaattagccaggcgtggtggcggacgcctgtaatcccagttactcaggaggctgaggcagaagaatggcatgaacctgggaggcagagcttgcagtgagccgagatcgccccactgcactccagcctgggtgacagagcgagactctgtctcaaaaaaaaaaaaaaaaaaatcataatagcaaataaatggcattcacgttataccatctccttttttgctcatggcaagtagtgtaatccctgccagaacatgggaggagacaatgtaacacatgtgccattcatttactcagaggtatacagtgtctttccttatgtgttaccaagtttaggctgtctgcacccctctgtgcactgttttttggagactgttccaatgtcactaggtaagatgctaccccctgtgatatagcaagacatattttgtgcctagagttacaaggaaaatcttttttttttctatagaaacaagactaggcatgacaagtatatgtagttttatttgttcaacaaatattgagataatacactatggttagtactgatgtatatactaaccacagtgtattatctcaaaattagatatgtatacaaagttgacccttgaacaatgcgaaggttagggaggctgacctacagtacagtcaaaatctgtgtataatttttgactcccccaaaacttaactgctaatagcctactgttccttggaagccttgctaataacataaacagtcaattaacacatattttgcatgttatatgtattatatactacactattacattaaagtaagctagaggaaaaaatattaaaatcacaagacaatatatactcactatttataaagtggaagtagagcatcataaaggtctttattcttatcaccctcacaccgagtaggctgaggaggtgggaggaagaggaggaattggtcttgctgtctcagggatggcagaggcagaaaaaaatctgcatagaagcggaccccctttgtccaagcccttgttgttaaagggtcacctgtacgtctaattttaccatagtctttttgatgatttcaggtttaatattgaaactttggctaaaattcacccatgggaaaaatagaaagtaccatggatttttatataaaaggagtcctggctatactatttacaaagcatgctaacatatcacttttcttctctgagtcttcacgttttctgaatatcaaaggtttcaaacttcagagagctgtatgggacaaatcaaataagacattaaaaacgcgttctggagagtaaaaatgctagcagatacaggtgtctcaacttacttgttaccttccatttctgtcccctactcacattgctttcttttctgtaattgtgtttaaagctgtccaaagagactctccaaatgctgggctctctgtctggaagtttcaaatgaggcttttggatgtgcatctttttctctgagggtaggattggggcaagaaagaaggtgatttaagtgtactggttgcctgggtgacaattaactgggtattgcttttagggagtcatacagaaaaatagaaaagaccagtaaaaaatgccatcctagtttgaatgctggatgtagtgaagggggttttgatgaagaaactgttgaggatcaactgagattagaaccacttggagaattaaaattttaataaggaggcattactttaaagtgaggggagggatttatcctaactgatgccttgttaaaaagaataacacagagtaaatagtcctaagaacaattgcaatcctttgtagtctgtaatttgtaattgctgcacataatttcagttaacaggccataagaggaacagtcacaaataccaagaaaggtacatacggagataattccaaccaaggtgagcacagcctacacataaacaggatgtaagtaccgcaagtcaccaaaactacactcaggagaaagtgctcgttattaacagacagtggattagtttcaatatctacaccaggggtcatcaaataggcccacagggtggtcctggatttgcaaacacagctttttgttgttgttgttgttgagatggagtttggctttggcttttgttgccctgttgtccaggctggagtgtaatggcccgatcttggctcaccacaacctctgcttcccaggttcaagcgattctcctgcctcagccacctgagtagctgggattacaggtgtgcaccaccctgccaggctaattttgtatttttagtagagacggggattctccctgttggtcaggctggtctcaaacacccaacctcaggcgatccacccacctcagccacccaaagtgctgggattacaggtgtgagccaccacacccggccgcaagtagagttttactggaacacggccatgtctcctcatttgctattgtccagttgctgcttccacactaccaggacagggctcagaagttgtgatagagattgtgtggctggaaaagcctaaaatattcaatgttctggccctttgaagaaagttaactgaatcaatctagactgttacacttacagtgaaaataattaaggattaggagttggaaggataactcaataattccattcatttgtgatgtgtattgtcattatttcattcaatcagcaaataactgtgataacatgtgcaaggaaacatgggagatgcaaaagtttagtaaagcaggtatcctgctatagtggagagagctcaggactatgcagacctgggcttgaaacccaacttgaatggattaagtggctttgaaggagttacttggactctccttaaacctcagttttcttgatcatttcacatcatcatttcataatcacgatcattttctatgggcatatctattcaaaatctctctatcagatcccccagtcaatatggagattgtggtaggcaccaagacaggaaggtgtgatttaggatcaactggatttataattttaaaagaatttatttatatgactgatgttttgtctggtggagcctgaagtaactatgcaaaatatctttgtattattactgcttgtttatgttacttatatagttatattatttcccaatcaatttcatcttttgtatttttctcttcaaaagttttgggctttacaatctcaaaacacattttcatcattcacatatttaaaaagtgacttttttcagagttttgttattgaagcagtgatacaaaactggttgactttttttctggggcagaggagagagtcaccaagtcaattgaattaatcatttacctcaccaccatatataccagacacagataagacaaactgacttttataaaatccctgcaaacccatcattacaaacattaactgggtcaatttcacctgaaggcaggattactctttcctataccaattttggatttcccagattaacccgttttttgttttgttttgttttttttaagaagtgtggcattagcaacatattcaaaagtctaaatgcttataagctgctttgaaaaacacattcaaaagtagaaacaaggttttagggaagcaaagataggaaacatgaatgagggtttagtaaacatagcataagacacttgttatcgaggcaaaaggattaattgagcagtaacatcatcagctatggttggacagaggagtggagataccagaagtgctatatccctgcacaaataaggaatctattttcagtttagactccaagcaggaagatactgctgctgcctcttgaagtacttcgttctttttctctgaagcttgaaaagtcactttacccaggagtggtgaatctggggtgctgtttctgtacctcttcacgcaacttgattggcatataaagatattgctataggtctctgggtacttcagtttctattgcctaaaatatgcttccaaaattagaaaatatgagcttaactctcgtaacagctgaagaagagcttacaaccttagaagacatagctctgtaattctgaaataactcaaaaactattttaaaatttcttcttctccagtcttccttcttccaacacataacattttcccaagggaaggcttgtaaaagcttctcaacagagaaaactcttaggaaagaaatggaaaattatagccatatcaatgaaacctaaaaatcaggcaaaatacataaaagggaaagagatgttattcctccagatttatacattcacatcttaactgatgaaagcttctctgatagaagtctgccctgaccccctgacatgacataacctccacagtcatttttttcacaatcatttcttatattctcctgctttattgtcttcatagcactctgtcactatctgaaatagttgttctgcttgcaccgttactgacaattcctcatcccccatttcaatgtagacactgaaatcagagcctcttctccatttagcttagtgtctagcacatactacacattgaataacatgtggtgaatgaatgaatgaatgagatgttccatggcagagttcatctcccacctctggttgatattcagtcccagcaaggatgtgcagctatcaagaagtaagcacacactccaatcttacatctttggggcattcttcttcggactgttgcaaaaaatttccttgtaatgtatacagagagcaactgaaaactctgaaactctaacgcattagacaaatatagatcttttaatgaatacttttatttaataaccagaatagcccttaggtattgtctaattcacagccctttatatagcaatggagaaattaaaattaaatggcttttttttccaaggtcacaagctagtcttagcttgagccagtatgaaatgccacgtctctgaactcctagcctggtgctcattttactggagccaagaagataccttcattgctgggcaaaggaatgaacaatgattgagtacctaacacgtttctaggcactttgttaactggttgtggtagacaatgtgtgttgctgacccaagcaccatttcttcttcctttcttccttacagaatcccaaatttttaaagtaagcatcccatcagtagctctagagtcagattctgtctagtctaagtcatttcatgcttagcaggtcccattacaacagccactggtccaggggtggccacgtaatttaatttggttcaatcgaattgaaggaaaagaaatgagccatgcctggaggacatgattctcttcccaccttcccctttcctctgctagttataaacagggcgatctacagcccaatggctgcctgtagccatcttgtggccataaagagattcatctttaggatgaaatcactgctgaagatagtaatgtctatatttatattaagggtcagtaaactctgcaaagaatcatatagtaaatattttagcattgccaatctgatggtccttggttcctgcagcaactattcgactcagacattatagtgcaaaagtcaccagaatgacatggctatggttcagtaatatcttgttttcaaaaaaaaaagtcatcgggctgtttaaatcattgaacctttttgacatcattgagccacatatttcatcattccttgagcttatcctgcacattaactcccaatatttgagatgatcaatttccttatgatttaaactggctttagtaagataatttttaaatgttattactaaaaccaaatcaatataattaattcagcatttatatacattattactcataatattcacaaaactcccataaagctgatattagtagactcattcttaagataagaaaatagaaccaaagtttcagagtctttgaaaatactggttcaaaaaccggcatttgaacctatatgtctaatcttctactctatgatgacccaactcccaactatctattcctcagcacttaaaagtggaagaacagtagctgcttcagtaaagttccaaacccaccaccagcttatcaaacagaaaatgatttcatgcagggaagtgtgcacttagaaagtcttttgaagggctggaggaatggatgtcagtggactgcccctgaatttttagtttctaggtcataccattatatgtgaaatccaaaagtcaggcagtggctactgctatcagttcctaccactgtagccaccatagcctcctcacaccaatggctccccagaatgtcatgttgaaccactataaacttcataactgtcaaattttacccgtagctacagctgcataaaaatggcctctgcctcacttctgatttccaaatctcttacaagtgcatgtaaatgactctagctgcaaaggagtttgggaagtatactttttaacctctccaataggaggatcaaatggagattggtaagacttctcttcagaagattgactaaggcttctccctagaatgtctggcatgtgtatctcccatacctgacaaagaatgagggcttcaagacagctaaaaaattttgaacaagctttaaaggactattttctcatccccagtcccatcagctgagccagaataatgacttcatagtaatttttccctgtacctttgagggaaagtaatgcattcattattggaataaaagtggttcatgtgtataaatcttgcccttggcaaaataaattatcaaagctcatgccaatgggagagatggcaggtccatgatgctaagagccaagttccataaagtgatagggaagcagctttcttttatccaaaagaatttatgttttatggctcagtgttggtgaggtattgatcttccaaatgagacactgtggccactgtaaataaattcaatagatgtgtagttggcctaagaatataacctcagttatttaaaacatgtggcacttgatgcagatcaccttccagtgtcctgtgtggaagaatggagcttccacccagtacaaagagtactctgggactccatgcctaagctccttaattagcatagtacatgtttgggggtaaataactccacctctctcaatcttaatttccacagccctgaaatttggacatgatagtatgggaggattcatgagaaaatgtgtgtggaatgatttgaacttcttgaagaatacatactcaggaatactgctatttgtgatgagatagtgtcagatgcataaatttgggttctttgaattactggcatacaggaaaatagcaaatctaggtcaacagagacctttttctcagactgcctttactatgaataaaacacaaaggaacttttctaactttctcagaaaagtgtcaacttctataattatttcaataaataatcttcctccaggaggatataattttaaggtgtgtgcagtgtccttttaaagacaggtttgtaggtctcactttcttttatttccaagttatcccctggcaacaagggctgtttatgtggagtattaaacaagcttcaggactgtgcacagaactcactcctattatatcttattttaatctgatattaccaaacttcccatgaactaaaaaaaaaaaaacccataaattttaagtccagtgagatttctgttttctctggaaattagagagctgaactgtgttttgtgtgagatcatccaacagtttttttaaaaaatcttacttcagaatcacattgaaatcattatgtcttctggaaaccagctgatagccaaaacatttatttaaattgtttataaaatgggtgggtggtatttcataatagttattggtttactatgcatgacctgttgatctacctgttgaaaccattattttaaaatatatttcccccaaaaatgctacttctgtatatttgtttttatcaaatataaatttacctagctcttttaagacacagatctcacccactgaattatgactaacatgaattttggaaattgtcctattttgatatgtcaggagagaacgttttactagcaggtttcattagccaaggtggaccagtgggtattttctgacattgcaaaagcagcttcaaagtgccactttcctttcctttccaggatgggtcaaataaaacaactctactccattctgtaagagattcaggcacagaaaggagaagatactgggctgctgacacattttctattcataaatgcttctgtttatagtagaaaatatgacattcaccatgagctgaccagccatcagttctgacatttatcagcgtcactttagaaacccatgtgggaaggcagaaaagcagaagggaacagaaactcacatgccacttgtagcagaatgcttgtgccatcctgactccccctctctgaaagcctgactgtgcaccatcctccttgataacaactaccaaccactgagcaagcctgcggtaggttatgtaggttctaggggaaggggatacaaagctatgttggacacttggaaatgcttagaatccagtcggggagccagcacaggaaacagaaacatctgaatgcatagccagctactggccctctacatgtatagccagctaataatgtgtgtgtgtgtgcatgcacacacacatgactagaagaggcattgtgcctggcagtgaaatgacagaggaaaggcatttattgtatgagggaaataaaagtagggaagtggtatcttaagagcaaaacatacagtctattccttccactccaaataattgaatgcttctgaatgtgcattccaaattttgagattaaatgaataaggccaacctgctgctgatggccacagtcagaaaggagggaagagaccacccaacccaggacaggaagtggagcagacttcatctggaacttgggaatgcctgcctccatgaaaaaaagtgtaagtgagatttccccctttttgatccatcttcaaccacttgataaattttcacaaaatcagtaatttcccaatgtggttgtgatggagcagggtagcttcctatttgcaagcattgggttaagcatctatgttttaaaagaattaaacatattaatataatactgtcccaatagtgcttacaaaacgtgtgtgggagacacactgctgagtttcaggaaataaacatcccttaacacaacacattgtaatcaaagaagcatattcacaaaacgttaaaactttttgccaacttcatgccagcaagcccagagggagagaacacgtatgctctttttcaatagagtatcacattatagacccattcaataaggtctgtatgagttcatttgtttccagataaagatttctgtgtgtggggagacttaacaacaaccacaaaaaaaggcttcgtggagaagggaacaaattagttggtgttttaaaagacagaagtatgtagacagtgaaagaggaatttgcaggaaatgtggtgggaagggtaccagtaaatcttaaactgagggaagagctcaggcgaaacctccagtgatcttcacaattctcaggagaatgcttatacatgatttgcacacaaaatattgaatttgaaaaaatcttatattgaattcccaagccacttgtagaatgcaatgtggcacactaatgtggtagaagggacataaaacaaacaaacaaactccctgcacaaatacccatgggaaaggaagaacagcctcacagaacttcaaaaagagaaaacaaagaaaaaaaatctcattttccaatgtatgcaaacatttattttctgagcaaagacaggattacaagtaggcagaatataagatttgaaaagcaaaaggaaaggttacatctccccaccacctaccacccacaaaccagttcatccacaggcaagctgatactgagactctacaactacatatttatacttttgacttaaatgtggccttctcttgaacagcaaataatcccaagatttacaaattaagccacatgaggcatttacacattaaagaaatgaatttttaagtctttcttaagacagagatttttgggtttggaagacagagaaagaatgagagtacttaggggaagatggcatgggttaggggtgacatttaggatgaagtgaagagacaagttatagtagcttaattcatagattaaaaggaagacctttataggaatctggttgtatagctaggagccaaacagccccttcctgatcaaaaatgttttcatctagtcttttacaatagaaatttgtttatcttgttttaaagtattctttatgtcatgcatgtaaataccaataaggtatttaaatattcccatattgacaagtatcgctttgcttctaatcttttttttttttttttttttttttgagatagggtctcactatattgcccaggctggtctcgaacttctgggctcaagctatcctcccactccacttcaccatcctgagtagctaggattataggcacaagccacctcacctggatttgcttccaatcattttctataagcaaaatgttacatgaaaatacttgtatttatatctttgtaattttgtgcaagaatttctaaaagaaaaaatcttagaaatcctagaaaaatcccaagtcaaaaggcacttgtatatataattttgaaaggtcttgtcatattgctctccatagaagatacaccaatgcatcttcccacctgcaatgtatagaacacctgtgtccccatattcttttttctttttttttttgagacgaagtcttgttcttgtcacccaggctagagtgcagtggcacgatcttggctcactacaacctccacctcccaggcagagaatcaagagaatcaagtgattgtcctgcctcagcctccccagtagctggattacaggcacctgccaccacgcccggccaattttcgtatttttagtagacacggggtttcaccatgttggtcaggctggtctcaaactcctgacctcaggtgatccgcctgcctcagctccaaaagtgctgggatttcaggcatgagccactgcacctgacctgtgtccccatattcttgccaacatagtgtattatcaaacttgttgatctttgccaatctgaaaagcaaaagtagtattcccttacagtttcaactgctttttacttgacttacagtttatctgggtagaaaatttagggatcacattctttacaggttgtggttattgcttcaaaagactctagcattttatattaatgtagagctaataaggatgacctgatttttcttcccctagaagggtctttaaccttttgcctgcttgaggagtcctttattatatttcaagtccagtagtgttaacagaatatgtcctttaaatatatagacttagatctccttttataaataagtcctcttgaattatattttcaaatacatttgaatcatccaccacttttctaaactctacaagctcatatttctttccgtagtcttctcatatctttcctgaactcttacatgaattttttgtgcttttattttatgaaagcagttgctttaagtcttattttaatttcattgatacatttaggaacaacttttattgttctgtgaaaaacgggtttgttttccagagattattctgtaactgccatttggtttttatgttctctttaaaaatgacaatacatactatgctagtttttgttgtttttaagaatatacctttttcatttgactaaaaatccttgaccagctctttccagaaaatgtggcaggggaacagagacatgttcaagtctaaaaagacagaattatatatgttatttcaattttacttcgccccagtctaccaaaatcaattctgcagagctgctcacaatgtgaaatttccttatgtcctctacctcactgatactctacctgcaaatgcagctcatctgtgaacatggcccataaagatttccctctctatttctcctcagaatcagactcagggaatttcccactaagagtccctagaccttggtcctgttgtaaagaaaaacgtgccgttttgcaataggttgtgccacttaagttagaaaggaatgctttgccaacattttctgagctctgaagttatgaccatttttttccagtgtctctctccactcacacctgtttcaccttgactgatttggggtgctcgcttcttattttgcaattcagagatttaagtagtctgctggtttcaaccaaaaatttaacttttttgctttttatttttctggttagtttttaataataattgaaagaaaaaaataagaaatggtcattttaatcagccaccataaaactaaattttttaatgtttctttaagggaatattttaactatattttgtttcttgtattgtaattggtctatttaggttatctacttttcttgagtcaatgttagtaatttacagttttctagaaactatgcatttcatctggattctagatttttttaaaatgtatatgctattttacatatatttcgttacatgtataatgattacatatatgataaaaatgatatatgttattctttttatttttaaaaagttctctttatttgtaattatatccccttatcttctttcttcaactaacttacaaagtagattggtacagattaccagatacttttcaatgttgtttaattcataattttttctttgcaaattctgatttacttgcattttacttattattttccttgatttagagtacaatactttatattaaactatgttgttttcaattaagcattttggggattgtgaaattaactctgaatattgcttttattgtatctcggagggattgatggttaatattctcactgtttgtttttaaaaagtttctaacaccaattttgattctctgtttattgtcactgttatgcattttttaatttctatggtaaatggatttaattggctattaattcattgttcttttctaaatttacgcatgtagtttaatgatatagtctgaattatatccatttggtattttgtttttaatttcttgagatgatgattaatgactaatgtctagtaaattatttcagatatttcattaatgttaaaaataatgtatattcttagcttaagtaacatatttctatgtttagtaaatatatgttgttcatcatgttttaaaaatttcctgtattcttagtttccaagaaaaaagcattaaagtgccatagaatattaaagagcaattaaaagaatgaagatctcttcatatgctggtaagaaaagtcttccatatgtttagtgttaaactaagtttggaacatctacaagtctttgcccaaatactctcagtgaagcttgcctggccatcttatttaaaattgcggcactcctcaccacacacacaaacttctcacccctcttcctctgctgtgcaatttcaccgcattgccatcttctaagatgttacatgatttgatatgtgatgcttattgctcatcatctgcttttctccactggaatggaaacttcacaagcccagtagtttttgcttcctttggtgaccaatgtgtcttggtgcctgtacatgtgggtgctcagtagttacaggttgaaaatattagtacgtgcattacggtaattcatgtaaaaacaaaaccacaagctactttggaaacaagtatatgcaaatgtatagaaaaagatctggcagtacactcaccaaattattaacagtgtttgatttgaaggtgtgactgaaaaatcaagacagctattaccttttatcagatatctttccattacctgctaaatttcatacttaaagagtattgtctttgtcattgcaatgttaaaatttttatttggaataataaaccattcagaaaacaattaaatattttgataacaaagagtaatagatgaggactatccttgacatacatgaaaatacactataagattccaatcattcaattagaatggtattgataagagaacagacctacaaatcatggaactaaacagatatctgatatagattacttagcatatgtaagaaagtaccacataacaaaagagacctttcaaatcagtgacaaatagaaggatataggaataactattagcttttggaaagacagggtaaaacaatgtaaattttcactttatatataaaaatatgagtagatttgtgaacatgaaacatagcactcagcacagaaaacatcataaataaaatttaaagtccaatattgtcttagaaaaaattttgaacaaacataaagacattaggttgagatccttattaaatcaaggtcactaatgaaaaacactaaaactctagtaaatagaccaagctcttaagtatgtagaactgattcaactataaaccaccagtttgtttctctgatttaatgggacaaaaggcacttgcagatggttactttatacagagtgactctatgaacaaagtctgtggaatccacaaacagcacacttgcagaattttgaaaaagctttgagattgtgggagtactgccctttacataaactgagacttcccacatttatttttattgtagtttaaacacaattcaaggatgctagttcaatgacaaatctgcacgaagtaaactgggacaagaggttattcaattgcccagaacaggaagaatttgtctctctatcatccctgtcaataataattagccctttctgaaaagggtgttgtagatacacagtcaaaatgatccttaaagggaggatataatttggcttacagaaatccattaccaacaaataactgcttgtggaggaaatatacaacaaagcaccacacttggaagtgataatcacagtaaatagcatccctagcctagattgggtcttatataagaaactatcatattgccaattaacaagtattttctcagtgtgatgacactttgaaatggctaaatacaaaattgggaggagaaaagaaattgcttagtctcctccctacccctcatcccctgcctccacagctccccaaactacacaagagaaaactcaataattctgtaagaatgattttcctggctcagttttataagagacttagaaataatacaacatcagtttataaaccagacagggcttggcctgctatgtcaacatagaaaatcaatccaggagtcccaaccctgctttgtggcctttagggctgcttcagaaatcaattcccaagaaggataaaaggtcactgccatggggctcaggaacacatgcctcaaattgccagctgcagagctcaattcccccagggacttggcaatttcggctctaaatgtggattcacaagggagagccatcctgaccaagcacatatgctcttttgaggtagtggccattttcatgccgacatttttgaggccctatcatgggtcaggactgagctgaggctttccatgcattgcctcactgaatctccacaataactcctgtatgagtccgttttcgcactgctgtaaagaactgcccaaaaccgggtaatttataaaggaaagaggtttaattgactcacagttttgcacagctggagaggcttcaggaaacttacaatcatggcggaaggcgaagaggaagcaaagactttcttcccatggtggaagaaaagagacagcgtgtatgtcagtgcaggaaaaactaccatttataaaactatcagatctcatgagaatttgctcactatcacaagaacacatggggaaaccatatctataacccaatcacttcccaccaggtctctctctaaacatctggggattacaattcaagaggagatgtgggtgttgacacaaaccctaaccatatcagctcttgagtagatgctatcattatcatcatcccccttcacagaagggcacagagggacttagagcatgtggctggccaaggtactaatctacccagtgaagtcagaccttttaacctttttctggtatgtttgtattcattcactggggctgccttaacaaagtaccaccgattgggtggcttattcaacagaaatttattttctcacatttttagaggctagaagtccaagatcaaggtggcgtcttctgagacttctctatctggcttgtttttttcctttgtcttcatatgatcttccctctgtacctgtctgcttcctaatctcttcttacaaggacaccagtcctattggattagggcccactttaatgacctcatttaaccttaattgcttccataaaggtcctacatccaaatgcagtcacgttctatagtattgagggttatcactttaacatatgagttggggggagcacaactcagtccatcacattctctattattgtaattgttcagatccatttatctcttataaaccaatgatcaaaacctgtacatccaactctctgcccatcccataagaaatacctggttgtggctggagaaagagctacaatatactggctggtctcacttggcatgttcttgacattcaggataggcggagtgacccagcaatcatatagacaccatccattccagtgacactcaaacttcagcgtgcatcagaatccctgcaaggcttgctaagacacagactgctgcgcctacctcagagttcctgattcatcaagctggaagtaaggcctgagatttttgcattactaacaagtcttcaggtgataccaatgctgctgatctggagactgcctttgagagccactattctatctctttcccaatcaactgtcctttctcacctcccttttaaatctccagcacctgctccctcatgttcattctcaatgcacaatctttttttctccttcactgacagaggtgaaacaattaaaagagaatttccccagtctctcactactgcacctgctcaccctcccacaagcacgtgtactcactgtgcttttcttgctgttttgaaaggtgaattgtctgtggtctttctagagccaatctcttcacatgtgcaccagattccaagccctgcggcccactcaagggcatccctgcatgtcttctcccatctcttaccttgtcaactctttccactttttgagtcatcctcctcagcacaaaagattgttactcatttatcttaaaaagcaaaaaaactaagccaacaaaaacaagaaaaaacagaaataaaaccttttactggaccctctctccctaccaggtatgactccatttctctttgcctttgcagaaaaacatttagaaagggggtctgtattaattctatccagttcctctcctctcattctctcacagacccactgaaatcaggtcttaactctcaacaaaattgctcttactgaggtctcagataaacttcaggttgctaaatctcatggctcacatttggtcctctcacattttacgccccttgacagagatgacaccactccttgatactttttttttttttttttttttttggcttgtaaggctttctaattcactggttgctagtctcagaactttgtgaatgatttatctttgcttatacctcttagtcctggactgacttgccccagattgtagtttctttttttatccactctccttcctttggggatctcatccagtctccctctgtatgccctttgttgccaaatttacatctccagccctggatgctcctttgcctcagactccaaaactatattcaaagtctctcatttagatcattcaaacttttcaagagtgactcctgatcttctcccaaatatctgagctgctcaaagctttccatctcagtagatgaaaaattcacccctctagtgcttaggtcaaaaatctttgagtcacccttgtttcctctctttattactccccccactgcacatccgattcaccaggaagtcttcctgtgtttaccctaaacataattcagagaccaattactcctcaccgcctccatggctatcactttcgtcagacttgctacattttagcaatcgtcttataactgttttcctattcccacccttgcctccttccattctattgcccacaaagaaacataagtgatccttttgaaacataagtcagatcacggcatttctttcccaaaaagaaatgcaagtgtctaaattcttcgcctacctcagggtaaaagtccaagttcttatatggcctttaaagacctctgtgtactctcctcctccctccattagttctctgatcttcccttcttcttttcttcctcatcctactctgctccagccacgcagtctttctggctatttcttgaacatagtaaacatgatccctcctctgagctttgagttgtttcctttgcctgggaaattccatctggagacttccgggcttgctcacctatataggcaagtctgtacatgagacctgctctgaccactcaatttaaaatggcagcaaaatccttcctggcaccccacctttaaaatggcaacaaaagccttcctggcacctttcctttctagctttggacctattacataatctatgtatcttttgtgttatcatctgccttccccgccagtatgtaaactccacaaaggttgagatttttgtttggttcactgatgtatcccaaggacacagttcagtatctaacttgcagtggaaactcaccaagtatttatcaaattatttgataaatgaatgtgatgataaatgaatgtgactgtaaaatgatactttatagtcactggagaaatcagtctctgacatccccaggaacaaaatcaacattctttggaatagtcattgataaagggttcataactttttgtgccatggacttctttggcagtctgtagaagcctatgaaccccttcacagattagtatttttaaatgtacaaaataaaatcaataaactacaaatgtagtaaattattttatcagaacatttttaaaattataaaacaaatttgtagctaatagtaatacacatacttcgttatccattaattgacaacatctggtagtggttctaataacgaccataattttgaagtactgatgtctagactgatatttcaagatgtctgtaataactctaacgtgatacgaatgtatctgtaatttccactgtgaataaagtcactggtactgccaatagcaccatggtttcttgcctatattcataaatgaaggaaatgttaaattttagctagttaaaaaaaaaaaatgaaaatgaggttgtattttctacagatacttaaatgaatgctttggaaacacttgtaaggagtagaaataaaagcagaaagactttcccctttcttactcccccagaaggtgctactgaattgttgcagataaggaaattgtaagataattgaaaaaatgataaaaatctggaagaattctgtgccaagactgtttttgctttcgcaagtgtctaaattcttgttctactttaatagaatcaaatctgcaaattatcagagtgatgatgtacatggttcatataaagcagacaatgtggaactccaagtatctgaacaatcagatcaaaatacccagactacatatcaagaaagcaggctgagtgtgatggttcatgcctgttatcccagcactttgggaggctgaggcaggaggattgcttaggaactcaagaccggcccaggcaacatagcaagacccttctctacaataagaaagaaaagaaaaaaaatagaaaagaaaagaaaaaaacagaaaaagaaagagctgggcatggtgtcacttgcctgtaatcctagctactagggaggctgaggcaggaggatcccttgaccgcaggagtttgaggttgttgtgagctatgattgtgccagtacgcttcaatccaggcaacagagcgagaccctatcttttaaaaaaataaaatagaaagcagtgcctccatgtgcttcaatgtgcatttatgtatttaagataaaataaactttttatgatgtatatttataatttcctatcatttttcactcacagttttgtggttttctctttcttttcttttctttccctttcttttccttccctttatttttcttcttccttttttttttattcaccaactacccaccttccctaattcgtaggttagaaggatttctctacagttctttctcttttttccaatctcttctggatgtttctttgtctcaaactacatagacattgtggaaatcagtatcttcatttcaagtctaggtgggtcaaatttgattctcttgtattttcactcttaaaatagcatcttgaactttcacctgtgatccatctataaggatcaaatgtaaggacttcaagagggcatctgcccaataatttctgtatacccagtacagcaaacagggtggtattgttgatgtgtactcagtgcatacaatagtatagtagtgttgtatatgctttgcagagagtagcattattgttgtatcagcacataggacaggacagttttattgcaacataaccaaaacataggttaaatgttaatgttgttgtacacccagtgcatagaacaacataaaattgttgttatatgttcaatgcaaaccacagagtagaatgctcaatttttgttgaatgacataaatgaattaaatggacacagcatcacctacatgcctcacctacaaaggcctaacttgtaatgggattactattgttgttttaataaattaagcaacgaatacagtttcaaaaagtacttagctttatttttcaacacagtaaatatgaatataacccatatcagtaaaagttgtttggggtcttcaatgatatcttaagactataaagaggtcctgacaccaaaagagggagaagcaccgcaatcttgcatgctcctggctcctgagaggttattgcagtctgccatactattgtatttccagtacttacatggtgttttggcaaaacctgagcatgtgttgtcaagtggctgatgaggatgtgattctgagaaaggcaccacgagataaaagatatgaatctcagctgggcgcggtggcccacacctataatcccaacacttcaggaggctgaggcgggcagatcatgaggtcaggagatcgagaccatcctggctaacacagtgaaaccccgtctctactaaaaatacaaaaaaaaaaatagctgggcatggtgacaggcacctgtactcccagctactggggaggctgaggcaggagaattgcttgaacccaggaggcagaggttgcagtgagccaagatcatgccactgcactccagactgggtgacagagtgagactccaactcaaaaaaaaaagaaagacacgaatctctttaacgtgagtaaggtttagatttttatcctcgtagaagaaacagcaacgcagagaatagacaaatctaccaaggtctcaattcctacaagttcccccagctgctgagtgtgaagccccacgaggttctttgaaaagtgttcctttgccagtctaaactgttctgggacttcattatagcaacgcctgctcaccacaggcaaggaaccagcaatctgatgaaggatttattgaaaatgtgggtaaatcagagtttttgttcccatgtgaatgattcccccggcaggcttgagctttagaagctctataaatacttactaagtaattaattgattgactaaagaaataaatgaaaaaaataacaataattataaatcgaggaaatgtaaaatatgtattattgtcacaatggatgaaaatatcccaaaagagatcatttggttgtgagttaggttttaaagtatacgcaatattagaaatgaataattgaagatagtttcaataattttaaaaactactgcccaatggtaaaagatataaaagattatgtaatttacaaggcagatgtcctatatctcttgaattattttagactgggacacaaaaagcccaggcagtcaagatgatattaaatgattcaaaaatagcattatttcaattaaacaaataaatgcccacaagacctacacaacaagctgaaaaagttaggtgcttatcacatcaggattctgtactaccttcctttaggaaaaaaatattattgaaatactaaattgtattgaaacattgtttttaaaagaattaggcaatgcatggaacatacttttgagtctttttccctgagtttcaaaacacaattcagttgtttcctttccaagaagtcaaacaaatattgttatttacaaactaggcaaatagcatcaagagaagaaaatatatttctttttactttttctgccactgaagatctactaacactagcagagaagaccattaatacataataaggccacattcaatgccccatgatttttattattctacatcaacttaaacaggggaattctaattcttttgactatgcacttcctctttttccattttcttttttttttaattaatgttaaaactttcagagctacaatattgcaatctattctttcaaagcactatttgcctattaaaagaaattccaccaagttcagacattaccttagcaatacagtagaatatttctctactaataaaaaaatcaactcctgcagttttaaccaacacctatgtgtaaatagtcttcttatttatatcacatttacaacatttccgctactcagttaaggtgcataagagcagaaactgtgacttctcagcactaggacctagccagatagtcattgccctgttcaaaataagtttaacaactgttaaatgacaagtttagatggtgccatctgaatcctccataagcactgcaaattcagcatttcattctcccattcttacttatctgtgttgattgcttcaccacctacccatttgttaaggtcaaaaatgttggcttcatcaatggctgtacactctcctccctttgaaattcttaccctattatttgcctagtcctacagattctctgcgaattctctattactacacaaatttagctttcattattactcatcaaaatattacttttgtctctttcattgtcaccaatagaatgccttctctaccttctccaacctatttcattataaagctagttgtgcttgctttctaaaaagtggatatgcttttgctttcctcccagtttcccctctgtttagatttttaatggctcccgattttctgtattatctaaatgctcagcatgtcctactggacttcactactacctttaaataacagctccccgaccagctcttgcctagactctccttgtgccttatatgaacaacaaatgtctctgtcttaagttggtttccccagaagcagattctgagacaaagatttgagtaccggtgctatattatttgggaaatgatcccgggaaacaacaaatgtctggagagagataaagagaaggaaagagaaccaataatttgtgccttgtcaagcaggtgttagaggtagggcaactgagttcaatctcattggggagtcctaaaagataatgaggaacactcttccttattatccaaccccaacccctcctgcctccaagggcaaggaaggtagagtgtgtattctccaatccatttgtcactggccaagaactgctactgcatacattcatcacttaccatttccagcctgcccaataaaaagaaagtctcaggtagagagttacaggtgattctagcagaatgccagaatgacatgggtaggcattgatgcaggactgattttatgcacataccacacagcctcacgtatacactattgttgtacataaactgttacttgtgtaggaactctcattgttgttgttccagtgaaattctactcaatctttaagcccaatgtcaaaagtcactctgattccatttctgaggaagaattaatgattcctcctgtacttccataatacttccttggagattaagatttcaacttgtactcatggttccacctttgtatcactatgcaatgcagtaatctccatttgacaaatcaggaaacagtcagaaagatcatgccagaaattacatgattcctaaaagttggagtgtggaactccaacctagccctcttaaaaatctactttgcccaataaatcagatatcctcaacctgaactgactatgtatctgctatattaaataattaaagaccaactggcctaaataaatgccctgctattcagagaaccagcactgcaatgtggaacagatctacctgccttataagcaagaagtccagtttctccttcttcaggctcttcactcctctggactgttcataatcatgagggtttcacaaaccaaaacaagaaccttacaaacttccacactcaagcctgcaaagacccagtatctcaagtaagcacttccattgggtcttgttgcagcatggtggacaatggaatgtggccccacagtctattagtcaatattggtctcctgctatggtcatctcactgctctagatgctttccagctgttcttcaaggaagcacactgaagcagtaagtgctcagtcctttcagtctcctacacagtcaactcagggtgttcttagttccaggcagcaggacagaatggttcaagcacctgtcacttcgtatgagtagtgctctttttccttcccttcctttgcttcttatccccatctcttgagccatcatgtcaatatcacactggttgttctttttaactctatttacaggtatgaatctcagcccacaaattcaggtgagcaagaaatctacagtctttacattataaaactttattttttgttgtaagagccgcctttctcgcatgactagtgggaaacttaaactcagtcccattcatgattttctgtcccttagtgggttctcagagagtgccttgggattaaggagtgggatctctcttatccttaagcatctgtccacacacagacagctactgagacaccctctgtctttctccacacggcccctctggcatgctggctcactcctgccaggcacacttgggacataaaacctttctctgagtttgtccatggaaaccatcttctcaaataccccatacagtcatttcctctcaggggttttccaacactcaaccttacttctgttgactgaggccttggtctctaccacacagggacttttacaaactatcttgctttctccttgcaagtggagacacatctctctagtcttacaggctttagtccagctctccctactgcttctggccaagatactctgtccagcctgccaattctctcttttctgtggggcttttaaaggacagataaactaactaataaaaagccagaaatattggagtgccatttgttctttctgctttttaacaccccttccctgagttgaatgagaggaagagatccctgagttgaatgagaggaagagaatcagagattcagggagaaaacaattctagattaatattacaaatgatttctccagatatacctagaaacacaaagaaataattatagccatttcatcccattggggttgttaactctgtccttactctacttaagctaatatcctaaatccttgtgcactaatatcctctttatatcccacttcctctccaaaatatatcctctttccctgctcctgttcttgtaggagtaattccagaaggccctgaccatcgctccccttttagggaggaattgctccctaaaagtccaaggtggttttctggctacaaatgtattctctaatgggatagtctacatgaaacaacagaaaacaaaattaaatgtgtcaattgatgtaacttgataaaccttaatatcaacatatttgctaccaaaggatgtggaaaaaggagcaggtggagattaaccagtgattaggaaacaaaattctgagtcagaacctggtcttctgtttcaaactttatcccttcatcataaaatacatgcatgtttctagataacgcaaccctttactcttttccaaaaggggaaaaatatctctgtgagtgtctattcctaaattctaacaagtgtcatcttagaaaacaaacaaaaaaaaattagaaaattgctgaacaatcctgctagctgctattcagttatgaagatcatagtcattctgttcgtgagatactctagagatgttattcagaggctgcttaggagaaaaaaaagaaaaatgcaaactgttagatctcagttaaataactgagtttattgcaatttaagctaatagttattcagtattcagtcaactatttggtgcaaacaaataaatattcttccacttgttagtccctaggggctttcttaatcctatctgaatttactttctgtgaatttctgagtaatcagaagttataggttggatacatcttgtgctagggacacccatggtgtaactgcttcattttttcttttcatttcaaaggaaatggtccatccaaagtgaaaattgttgtgttttatttttttttttggtggtagagtatattttcctctttgttggtgttgttattgttgctgttgttttaatcagatagttatttcaaacagaagcaatcaagttccttttttcactgccatctccctctacccttcctactcaatccatgctgttaagaaaatatccttgttagtaatgtgacataaagcagccttaaaaatccataattcagctgggtctagtggcttgcacctgtaatcacagcattttgggaggctgaggtgggaggatcgattgagctcaggaattcaaggctgctgtgagccatgatcacaccactgcacttcagcctgggtgacagagccaagaccctgccataaaaaaaaaaaaaaagattcaggcccggtttggtggctcacacctgtaatcccagcactttgggaggcctaggcaggcggatcacctgaggtcagagttcgagaccagcctggccaacatggtgaaacccccatctctactaaaaatacaaaaatgaggccgggcgcagtggctcacacctgtaatcccagcatcccagcactttgggaggccgaggcaggcagatcacctgaggttgggagttcgagaccagcctgaccaacatgtagaaaccctgtctctactgaaaatataaaattagccatgcgtggtggcacatgcctgtaatcccagctactagggaggctgaggcaggagaattgcttgaacctgggaggcagaggttgcagtgagccaagatctcgccattgcaccccagcctgggcgacagagtgaggttctatctcaaaaaaaaaaaaaaaaaaagattaataattatttttcatcagttcattcagtcttgtaattaattcttgctgtgatctgtattagcaatttcacaaacccatcagtttcttcattcgagttttggaattttttttttttttttgacagagtttcactcttgttgcccaggctggagtgcaacgacagaatctcagctcactgcaacctccgcctcccgggtttaagcgattctcctgcctcagactcctgagtagctgggattacaggcatatgctaccacgcccagctaatttttttgtgtttttttttttttttttagtagagacgggttttctccatgttgatcaggctggtctcgaactcccgacctcaggtgatccgcccacctcggcctcccagagtgctgggattacaggcttgagccactgtgcctggccgagttttggaaatttagttcaatagtgtgaactcaaagttattagaaacccgtacttgtcagacttcattctttccatgaagctccttgaagacataactctctgggattataattgcctgcaagaagctttcagaaagacattagactaaagcaattaagtgtggacatgaagacttcaagtgaccatggccaaaacctggtctgagtccatggtaatgacgacataattgacaagaatgttatttctgaaccaaaattgactgataccatttataccaagacacatcagatttttaaatatgttatacaatttttcagtatattaataacatatccatataaatatacctcaaggtgaaatatttcttattttgccaatccttctcttataatttattttatgtatttcttttttttttttttttgagatggagtctcgctctgtcacccaggctggagtacagtggcgcaatctcggctcactgcaagctccgcctcccaggttcatgccattctcctgcctcagcctccagagtagctgggactacaggcgcctgccaccacgcccagctaattttttgtatttttagtagagatggggtttcaccgtgttagccaggatggtctcaaactcctgacctcgtgatccgcctgcctcggcctcccaaagagctgggattacaggcatgagacactgtgcctggccttattttttattttatatttaaaatttttaaattttttggccgggtgcagtggctcattcctgtaatcccagcactttgggaggccgaggtgggtggatcacctgaggtcaggacttcaagaccagcctggccaacatggtgaaacccggtctctactaaaagtacaaaaattagccaggcaggatggccggcgcctgtaatcccatctactcaggaggctgaagcgggagaatcacttgaacctgggaggcggagcttgcagtgagccgagatggcgccactgcactccagcctggcccacaagagccagactccgtctcaaaaaaaataaaaataaaaataaaataaaattttttttgtagatacaggagtctcgatattttgcccagactggtctcaaactcctgggctcaagcaatcctcctgccttggcgtcccttgggattacaggcattagccactgtgcccagcctcatataatttaatatatcagataagcccagttgatttaatatttctttttttgtagatcctttgagaggttcaggggtcctctggaacatcctaaagttagtttgaggtcaaaaatacttaattttgatttttttttttttttgagatagggtcttactctgtcaccctggctggagtgcatggacacaatcatatctcactgcactctcaaactcttgaagcaagtgattgtcccaccttagcctccagagtagctgggtctacaggcatgtgccaccacgtccagctaattttgtttattttttgtagagatgggatcttgttatgttgcccaagtgggtctcaaactcctgggctcaagcaatcctcctgcctcagcctcccaaagtgttgggaattcaggtgtgcgccactgtgtctgccttaattttgatttttgaaaagtttgtcaaatatcaaagttttaaaacgcttgatcaaagtaggatcacaagtcactgtgaaataaaaccaaagtgagaaaatatttgaaagacacaaaacacaataaatactctttttttttttgagagggagtcttgctctgctgcccatgctggagtgcagtggtgtgatctcagctcactgcaacctctgcctcctgggtttaagcaattctcctgcctcagcctcccaagtagctgggattacaggtgctcgccaccataccggctaatttttgtattttaaggagagacagagtttcaccatgttggccaggctggtcttgaactcttgacgtcaggtgatctcactgtcttgccctcccaaagtgctgggattacaggcgtgagccaccgtgcctggtcaatttttttttttttttttttttgagacggagtctcgctctgtcacccaggctggagtgcagtggtgtgatctcggctcactgcaagctccaccccccgggttcacgccattctcctgcctcagcctcccgagtagctgggactacaggcgcctgccaccacgcccagctaatttttttgtatttttaatagagacagggtttcaccgtgtttgccaggatggtctcgatctcctgacctcatgatccgcctgcctcagcctcccaaagtgctgggattacaggcgtgagccaccgcgcccagccctggccaatgttcttgatgaaacagattctctgtttcctaggccagttacctaaaaggtaaagaaaaatcttttacaattttcttgtaaagggtagatcaatggtccacaaaaactctgttgttgcaacacaggggcccaaattgcggccttgtatccatcagtgtgcttttgatattaacgctcagtttttagcctaggcaacatgggaagacctcaccgctactaaaagtaaaaattagccaggtgtggtggtgcacacctgtagtcctgtctacttgggaggctgaagtgggagaatcacttgagcccaggagattaaagctacagtgagttatgatcatgccactgcactccagcctgggtgacagagtgagaccctgcctcaaaaaaagcttcaattttaggccaggcgcagtggctcaggcctgtaatcccagcactttgggaggctgaggcgggcagatcacgaggtcaggagttcgagaccagcctgaccaacatggtgagacccccgtctctactaaaaatacaaaaattagccgggtgtggtggcacacacccgtgatcccagctactcaggaggccgaggcaggagaattgcttgaaccagggaggtggaagttgcagtgagtcgagatagagccacttcactccagcctgggtgacagagtgaaactatctcagaaaaagtaaataaataaaataaataaaggaaaagaaagttcaatttttagaaaatcttataaatatttatggctttttttttttgagatagagtttccctcttgtcacccaggctggtgtgcagtggcatgatctcggctcactgcaacctccacctcctggattcaagcgattctcctgcctcagccttgtgagtagctgggattacaggcgcctatcaccatgcccagctaactttttgtatttttagtagagatgtggtttcgccatgttgagcaggctggtctcgaactcctgacctcaggtgatcagctcgcctcagcctcccaaagtgctgggattacaggcatgagccaccacgcctggccaaaaatcttataaataatccccttctaatttcggccagcttaatcacacaccaaattcctttcatgagattaatcttccacaacttctacacttccttaaatctttgattttgtcctatacttctttttttatattagcaatctactttaggacagaaatttactttcctttcctcttgattttgaccaaagtcctctcttatgcaaaatgaaaaattactcttttttcaactttctttaccaaaaatacatcctcatatttataactttttttcacatctctcctacttactggccttcttcccaccttgtttctatttccttcctaaatccatattttgaaacaatctttaaataacccccaacttaaacaaaattgctcttatttaacaaaaaacttatctcaaaaaacctagcacggtcaccaagcgtgctttgcttttctttctctctcttttttttttttttggaggcggattctcgctctgtcagccatgccggagtgtaaatggcgcgatcttggctcactgcaacctccgcctcccaggttttgagagattctcctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcaacaagaactgcatgctgggttctggacagaaatagagttataattaagcattcatcaggctgcattttggcccacttccttgttgctaaaagtcaggtggcactagttcctgaccattgcataccattgttcctgtagataggatttctgacattagagtcagaagactgttttaagaatttatttggggatcttctggggctgtatcacagggggaaaagtgaaattaaaaaaaaaaaaaacacaatcaatttgggctgggcgcggtggctcacacctgtaattccagcactttgggaggctgaggtggagggatctcttgagcccaagagttagagaccagcctggccaacatagtgcaactccatctctaccaaacaaaatataaaaattagccaggcatggtggtgagtgcctgtattcccagctccagaggctgaggtgggaggatcacttgagcccaggagttggaggctgcagtgagatatgatccagctactgcactctagccagggcaacagagcaagaccccaactcaaaaagaaaaaaaaaaggaatttagattaaaaaagaaaaagggctcgagtttgaatgcagtggctcaagcctataatcccagcactctaagaggctgaggtaggaagatcgcttgagctcaggagtgccaggctgcagtgagccgtgatcatatcactgcactctagcctggacaacagagtgagaccttgtctctaaaacaaaacaaaacaaaacaaaacaaaacttgagaatgggccagacgcggtggctcacgcctgtaatcccagcactttgggaggccaaggcgggtggatcatgaggtcaggagttcaagaccagcctggccaagatggtgaaacctcgtctctactaaaaatacaaaaattacagcgtacctgtaatcccagctactcgggaggctgaggcaggagaatcgcttgaacctggggggcggaggttgcagtgagccgagatcgtgccactgcactccagcctgggtgacagagcgagactccatctcaaaaaaaaaaaaacaaaaacttgagaatgatagtgttacaggaaaggggtccctacccagaccccaagtgagggttcttggatctcacgcaagaaagaattcagggcgagtgcataaagtgaacgcaagtttattaagacagtagaggaatgaaagaatgaccattccatagacagagcagccccgagggtggctggttacccatttttatgattatttcttgatgatatgctaaacaaggggtggattattcatgcctcccctttttagaccacatagggtaacttcctgacgttgccatggcatttgtaaactgtcatgaagctggtgggagtgtagcagtgaggacgaccagaggtcactctcgtcgccatcttggtcttggtgggttttaaccggcttcttcactgcaacctgttttatttatttatttatttatttatttatttatttatttatatattttttgaaacggagtctcgctctgtcacgcaggctggagtgcagtaccgcgatctcggctcactgcaagctccgcctcccgggttcacgccattgtcctgcctcagcctcccgagtagctgggactgcaggtgcccgccaccatatccaactaattttttgtatttttagtagagacgggatttcaccgtgttagccaggatggtctcgatctcctgaccttgtgatccgctcgcctcagcctcccaaagtgctgggattacaggcgtgagccaccgtgcccggccatcactgcaacctgttttatcagcaaggtctttatgacctgtatcttgtgccaacctcccatctcatcctgtgacttagaatgcctttaccatctgggaatgcagcccaataggtctcagcctcattttatccagcccctattcaaaatggagttgctctggttcacccgcctctgacaatagtagaagttaaaaaaaaaaaataacttctttaactccactccaggtggcatttcttagtgcctctgaaggttctgatctagaaccagcccccagctcacccagagcaaggaaagatcatgaaaacccaagcagaagcaagacactgggttccagcatcaatgctaagggctagaacattttctgatgttttgcttggaaaggcagaatttggttgtctagtgcgtccactaattggcctccatctgacaccctggagggatgggctgattagaagccacagctgctttgctcattatttctgatgaatggacatcacctggcgtctccggtgatggcgccagctcaggacccaggtgtgacctgcacaacaaagaaaagcaagatagctttgcagccaacatggtgaaaccccatctctattaaaaatacaaaaaaaaaaaaattagccggacgtggtggcgggcgcctgtaatcccagctactcagtaggctgaggcaggagaatcgcttaaatctaggaggcagaggttgcagtgagccaagatcatgccactgcactccagccttggcgacacagagagactctgtctcaaaaaaaaaaaaaaaaaaaaaaagatggctttacagccctgaggagtaaaccagtcttccccaaataattatcttatgtaagtcccagccccttggaacatgttttgaaagggctcacccatctgggcaggtgactcacgcctgtaatccctgcactttgggaggctgaggcaggcggatcacctgaggtcagaagttcaagaccagcctggccaacatggcgaaacccatctctactaaaaatacaaaaattagccaggcatggtgggacacgcctgtagtctcagctacttgggaggctgaggcaggagaatcacttgaatatgggaggtggaagttgcagtgagccgggatcataccattgcactctagcttgggcaagaagagtgaaaccccatctcaaaaacaaaagaaaaggctcacccttttcactggttcccttgtggcaaatctaaaataaggtacgtgtgctcgccgttcattcatctgaaaagttctaacagtttgcaaataccctctacccataccccacccccacgtgttgtccttttttttttttttttttatttgagacagagtctcactctgttgcccaggctggagtgcagtggcgcaatctcggctcactgcaagctctgcctcccgggttcacgccattctcctgcctcagcctcccaagtagctgggactacaggcgcccgccaccatgcccggctaattttattttattttatttttgtatttttagtagagacggggtttctccatgttagccaggatggtcttgatctcctgaccttgtgatccgcccgcctcggcctcccaaagtgctaggattacaggcatgagacaccgcacccggcccttttttttttaagagacaagatgtcaccctgtcacccaggctggaatgcagtggtgtcgtcatagctcactgcagcctggaccccctgggctcaagtgatcctcctgcctcagtctcccaagtagctgggaccacaggggtgtcccaccacacccagctaatttttttattttttgtagagatggggtcttgtcttgtcacccaggctggtcttaaacttctgagctcaagcgatcctcccacttggacctagccaggtgctgggattatgggtattagagtttaaatttctttgctcaacaccactccccattttgtggccaacagtcacattctttcttgggccacgtcattcattttcagttgcttcagagcactggtggccccttgggtgtgttgaacaaaccccagcctttgaggagttcaaaaaaaaaaaaaaaaagacaccatctctaggcggaaaatttcagacaaagaacccctgccaggaatatttcctgccgctgctcctgccactgccccttaggctgtggacctttatgcaagaacgcaagtggcaaactgccctactgtgtatgttgtggggagtgggggtactgccagagaggagagagccctattttattttattttattttattttaaagacagagtctcactctgttgcccaggctggagtgcaatggcacgatctcggctcactgcaacctctgccccctgggttcaagagattctcctccctcagcctccccagtagctgggattacaggcgcatgccaccacgcctggctaatttttgtatttttagtggagacggggtttccccatgttggccaaactcctgaccttatgtgatcctcccaccttggcctcccaaagtgctgggattagaggcatgagccactgcgcccagctgacagccctctctaaatctttaaaaattcagtcaggcgtggtggctcatgcctgtaatctcagcactttaggaggctgaggcaagaggaatgtgtgagcccaggagtttgagaccaacttgggcaatatggtgagaccctatcttgacagaaaatacaaaaatcagcctggcatggtggtgcacgcttgtagtcccagctactcaggaggctgaggcaggaagatcacttgaacccaggaggtcgaggctgcagtgagctatgatcacgccactgtactccagcctgggagacactgtctcaaaaaataaataaataaaatctttaacaattcttcagcttatccccctaccttctggggcttcttgggtctcttcccagaaactttcttcgtctgtaagcccgtttattgtatgcaattgtttaaaaaacacaaatgggtgcatattctcatattctctaccctctattttgaacgttccttttttttctttttttcagaccgagtctcagtctgtcacccaggctagtgcaatggtgcaattttggctcactacaccctctgcctcccagattcaagcgattctcctgcctcagcctcccgagtaggtggattacaggtgtgcaccgctgcacccagctaatttttgtatttttagtagagacgaggtttcaccatgttggccagactggtcttgaactcctgatctcaggtgatccacctgcctccgcctcccaaagtgctgggattataggcatgagccgccttgcctggctcaaagttcctttttggtttaacaatagatctaggccactgtgagtcttcctcattccttctagggctacctagtgttccggggttatttaaccagccccctcctaccaggcagttcttttgtctctggccctttgctacgtatattagtttaaagttcactttgcaagtggccaaggctgtttccctcatttccaggttcccagggggcagacatcctgctgcaatttcagaagtcagcacactcttctctctcctgtctaaaatacaaaagtccatgccccccactctccctcttgatactgtcctattttacttcttttcacaaccagaactctttatttttcccaaataaaaatagtccgtcttttcagattttaaaaatggaactctggccggatgcggtggccctcacctgtaatcccagcactttggaaggctgcagtgggcagattacctgaggtcaggagtttgagatcagcctggctgacatggtgaaactctgtctctactaaaaatacaaaaattagcccggatgcggtggctcacatctgtaatcccagtactttgggagaccgaggtgggcagatcacgaggtcaggagttcaagaccagcctggccaacatggtgaaaccctgtctctactaaaatacaaaaattagctgggcatggtggcatccgcctgtaatcacagttactcggcaggctgaggaagaattgcttgaacctgggaggcggagtttgcagtgagctgagattgtgccattgcactccagcctgggcgacagagcaagactccatctcaaaaatatatatatatacaaaaattagctgagtgtggtggtgcatgcctgtaatcccagctactcgggaggtgaggcaggagaatcacttgaacctgggaggcggaggttgcagtgagccgagattgtgccatttcactccagcctggacaacaagagcaaaactcgtctcaaaaaaaaaaaaaaaaaaggaaaataaaaatccctgataaaggatcaatgaccttaggataatgtcattccaggtaagtatctttaactgggtacttggtcctccaagattcagaggaccttgatccccctgaaactgtatacataatattcaacatacatagtatgtgcacacatgtgcaaacactcacattatctaaaattcatcataatcttaccccggcttctccccatactcctcagatcctgctatagcctagtgcattttctccttcctcactcccttccctccatgtgtcctctgccctggccaccaggaactttgtgctgcctccggagtgcatgaggcactttcacatctctcttgctttacaagagcttccctatgctccaactggcaaatttctctatggactgaaaaacccacatagcctttatctgtcttgtgatgtcttctccccaccctcaagttaggcatacccttctatgccctcctttatccaaacattttccccactatatcgtaattgtgtgtttaagtgccggactttccaactagatacaaagctttcccaggaaagaaatccttttcttttcttctttctttcttttcttttcttttctttctttttttttttttttttttgagacagattcccactgtgtcgtccaggctggagtgcagtggcacaatcttggctcagtgcaacctccacctccagggttcaagtgattctcttgcctcagtcttccaagtagctgggattacaggcacgcgccaccacacccagttaattattattattattattttttttttttgtttttgagacggagtctcgctctgtcacccaggctggagtgcagtggcacaatcccggctcactgcaagctccgcctcccgggttcacgccattctcctgcctcagcctcccgagtagctgggactacaggagcccaccactacgcccggctaattttttttttttttttttttgtaattttagtagagacggggtttcacagtggtctcgatctcctgccctcgtgatccgcccgcctcggcctcccagagtgctgggattacaggcgtgagccactgcgcccggcctccacacccagttaatttttgtatttttagtagagacggggtttcaccatgttggccaggatggtctcaatctcttgaccttgtgatctggctgcctcggcctcccaaagtgctgggattacaggcgtgagccaccgctcccggcgagaaaccttttctttttcttttttcttcttcttcgtctttttttttttttcttttgagagggattcctgttccgtcgcccaggctggagtgcaatggcgcgatcttggctcactacagcctctgcctcccgggtttaagcgattctcttgcctcagcctcccgagtagctgggattacaggcacgagccaccacgcccggctagtttttttttggtatttttagtagagacggggtttcgccatgatggccaggctggtctggaactcccgacctcaggtgatccgcccacctctgcctctcaaagtgcagggattacaggcatgagccactgcgcccagccaagaaaccatttctgattcacctattcactcccgcactcccactacacagtagctaaataaataaataaatattaaaaataaataggaaagaaagagagaaaaaaagaaaagaaaaagacaaaaatttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcgggggggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggaggagtttgcttcctaactctgcttccctgctttcctgtggggggtcttcccaggagttcctggggccctgggtcactttttggggtgcgtaaggggtgccgaaaaagatttagaactcggttcccttttctggagctgcgctttcatcgcgactgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtagactttctggtagccaccatccgggcttaagccatccggatagcaagccctctgattcggttgctctgtgaccttaaatatttaccctctctggtgtgttgatttcctggatgcttagctgccagactggcttatgaagtccttttagagttttctgtaaaagggctcaggccaggcacggtggctcatgcctgtaatcccagccctttgggaggccgaggtggaaggatcatttgagtccaggaatttgagacaagcctgggaaacgaagaggattcctgagatcactgtctctataaaaaatcagatgggcgtgttggtgggtgcctgtagtcccagctacttgggaggctgaggcaggaggatcgcttgagcccaggagttggaggctgcagtgagctgtgatcacaccactgcactgcagcatgggcgacagagggagaccccgtctcaaaaaacaaaaaacaaacaaactaaaaaaacgaactttttttttttttaagaaaagggctcagagccaggcgtggtgactcgagcctataatcccagctactcgggaagctgaggcaggagagtagcttgaacctgggaggcggaggctgcagtgagccgagatcacgccactgcactccagcttgggtgacagagcaagactccgtctccaaaaactaataataataaaaaattttaaaaagagctcagggtttttttgtttgtttgctttttgttgtttcttcaaccatctccttgattgttaagtgggtggaggaagactgttgtacctcgtgctccacccaggctattggaaaataaatctggtgattttcagtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggtgagagccatggggacttgaccttgctgccttctctgtctggtgcagagaaggtggggattggggagggtggaatttgaggtctgcaggataaacgtgtgccctgggagttgactgttgattgccacctgtctcaaataaattgcagtggcgtcttgccactgcttctcctgtttaactaactagtcttagaagatgctttccactttaagacatgctttatgggatagaagacacaagtcacgatttctgcatttgaagtggcagttttcatttcttttgttgcataaacccttactgggtgccagataagatctctgtcttttgggagtgcattgtttggtggaaaagacaaagcagagtcagtgacaaggtgttgtcagtgtgatatatactgagctgggagaaatcacaaggctctcctacccacatccagaaaggggacggttagagggaaggtcaggaaggcttctggaaggtggtagttgaggggggttgtgaaggaggagtaggacttagaaagtggggcacagtcgcctgggagaggagtcagcgtttgcaaagtcatgaagctaccgggacacagctgggctactgtaagtagctgagtatgtaatagaggaggctggaaaagcaggcagagggctctgagcgaggagggttatgtgggccatgccaagactcgggagtggaaggattttaggagatttccatgagggtcattttattaattatttttttgagttggggtctgcttctgctgcccaggctggagtgcagtggagtgatcatagttcaccacagcctcaaattcctgggctctggggtagctgaggtgcctaccaccatacccgactaataattttatctagagacagtgccgctctacgttgtccaggctggtctctaactcctggcctcaagggatcctcccatcccagcctcccaaagtgctaggattacaggcctgagccaccgtgcctggcctcgtgagggacattttaaaggagcacactggaacatgtggaatgggtttagactggattattcgctttgtggcggtcttcttacatcatgccagcttcttcgtggggagaggcaggtgagtggttttgccctcagttgcttatagtctagttgaagagataaagtggacatagagaactgaaaaggaacttgctaagagggtgttttctttcattctttttgttgttgttgttttgttttgtttgtttactttttgagacagggtcttactctgtcacccaggctggagagcggtggtgcaatctcagctcactgctcaacttcacctcccaggctcaagagggtcttgtgcctcagcttcccgagtagctggacttacaggtgcacaccatcatgcctggctgatttagagggtgtttgctttctgctgggcacgtccaggcatcgtgggaagtgctgtttaaattgggccataaaagggtgggtaaggtgaggacaggggaccaagtgggtgggattcagggtggagcagagtcatgggggtcgggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggtgtgtaaaagacaggatcagaacgttagttcaggaagcttaatcttttctgcccccccatctgagatgtacaagagggttagaaagcagagttggagaagctgtttgggagggagcacttatttgtttttttgttttgttttgtttttttgagatggagtctcgctctgttacccaggctggagtgcagtggcgccatcctggctcactgcaacctccacctcccgggttcaagtgattctcctgcctcagcttcccaagtaggtaggactacaagcacctgccaccatgcctggctaatttttgtatttttagtagagacggggtttccctctgttggccaggctggtgtcgaactcctgacctcaggtgatgcacccaccgaggcctcccaaagtgctgggattacaggcgtgagccactgcgcccggcagggagggggtaaagtgagaggcataagggtcccggccaggtgttagcagggggcttcagaggtgaggagagagcagggcaggcagctgctaggcctgggggagcgggctgcggaggactgagaatctgaggtttttctcttggccgcctgggggaaatccagggggaaaaggagaatgaggaaggaagatgcgtttggcctcagacgtgttgaaggtattaagaggccaacaggaaatgaggccatgggctagagagaagagccctgattcattccccaaatgcctcccgaaattctgtgcgccgaggcttgtgtttggcacttggagtacaaagatgaattcagcagtctctttggtgtttgccttatcagctaagctgagaacaagattgattagtacacactcctcagtgttcatgcctgacctacttttccttatttagtaagttatttttaataaatgtagtaagttctggcaatctaggcacccaaaacaaaagctgggatcatgaaacaaaagtatatatctaatcttttttttttaattttaaaaaactttaaaaagttttctactttatcaggtccccttagaacatctaatcatttcatttgaacttgttttctgttcttaccctgaggtaatcattatctcctttctttcattttttttcttagttttatcttacatgtgtatttctttgtttctctgtctcttttttttttttctttgaggcagagtttcactcttattacctaggctggagtgcaatggcacgatctcggctcactgcaacctccgcctcccgggttcaagctactcccgattctcctgcctcagactctggagtagctaggattacaggcatgcgccaccatgcccggctaattttgtatttttagtagagacagagtttctccatgttagtcagactggtctcaaactcctgacctcaggtgatccacccgcctcggcctcccaaagtgctgggattacaggcgtgaggcaccacgcctggcctatttctttctttttttagagacagtgtctcgccttgtaacccaggcagctggagtgcagtggcatgatcacggatcactgccgccccaaattcctgggttcaatggatccatccccttcagcctcctgaatagctgggactacaggcacaggctaccatgcttagctaatttttaaagtttgtgcagaggcagcttcactgtgttgcccaggctggtgttgaactcctgggctcaagcaattcacccgccttggcctcccaaagtgctgggatgatagacatgagccaccatgctcggcagtgttcatctttcgtagctattgctagaccatttcctgaatgaagtgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgattttaatccttcgtgtctattgcaaatatcttctcccagcttttaacctattattcctctttctttaaggtgtcttctgttgatcagccattcttcattttaacatagcgaaatgtattttttccctagtactcagttttctgggtctggtttgaagtcttttcctgaacataacccttgcctttaaggagcgtatgcattctccagtggaggagacagataatggcactgagacgtcatgtgggcattgattgttagaagtggccacttctgcctgtggagcgggagcgaacttaggaaagatctcacagggcagagtcttgagctaggaattaagagatgagtaagtggacaagtgcgatgggcattctcagtgggggacgaagggcatgaaacatcctgacctgccctgggcgctgccaggaggtccagatggcaggagctgatggtttgaggggctcgggcagggcatcccgaggacagctttgggtgatctgtatgcaagggaatattgaagccatgggaacagatcctgaggatccgggcggaatggagagaggaggggaggaggggagagggaggccagggcctgattcccggatgcagagaatgttatcaacgcctggtgtggctctggggagcacctgggacttcccaggggcgggtgctgttggcatgctgcctgctgtgctgttggatgctgtatttcacccttaggtgttgggcaaaggctgacatgtctgcagagggcagggcgtgttgttggcaaagctagccagaggcagagcactctctcactttttgatagagacatgagttcagagaagtattgctcaactgtaggagtgtgaaagtacagtaatagatgtgagggaggccacagggcagaggtctgcaaacgatggaccctcagccaaatctggcccactgccatttttttttttttttttttttttttttttttgagatggagtctcactctgttgccaggctggagtgcaatggcacgatctcagctcactgcagcctccgcctcccaggttcaagaaattctcctgcctcagcctcctgagtagctgggattacaggcaccagccaccatgcctggctaatttttgtatttttagtagagacaaggtttcaccatgttggccaggctggtctcgaactcctgacctcaggtgatccacccccgcttggcctcccaaagtgctgggattataggcgtgagccaccacgcccagcattttttttttttttttttttttgaggcagggtctaactcctgcccaggctggagtacagtggcacagtctcggctcactgcagcctccgcctcctgggttcaagtgattctcctgccccagcctcccaagtagctgggactacaggtgcacgccactacgcctggctcatctttgtatttttttggtagatacggggtttcactgtattggccaggctggtctcaaactcctggcctcaaatgatccacccacctcggcctcccgaagtgctgggattacaggcgtgagctaccgcattcagccccactgcctgattttgttcataaagttatattggtatgcaacccctcctgtttacacattgtttatggctgttcttgtggtctagtggcagagtcactggaaagactttttctgtcctttacaggaaaagcatgctggccctagccatagggagtcgtggtagctgtggccacccagagaggacgttccagccaccattgcagtttagctggtgttgctaggtagatcatggatctaggtccagcctgcaaatattgccatcttttctgattttcaagggaagcttgaaatctagatttttttttttttttttactgtgaatattccttttttttgagacagattctcactctgtcgcccaagctggagtgcagtggcataatcttggctcactgcaacctccacgtcttaggttcaagcaattctcctgcttcagcctcccgagtaactgggactacaggcgctcgccaccacacttggctaattttttgtattttttagtagagacagggtttcactgcattagccaggatggtctcgctctcctgacctcatgatctgcctgcctcggcctcccaaagtgctgggattacaggtgtgagccactgagcccggccaaatattccaatttttaaacatcagctcagtttttaaaagccaaaccttagtaacccaagcaaaacacatctacaggccagtttgtccgtcgtcagtctgtcttggtgggaaagacaggaactctggaaacagatttgggttttctcagcccctggatatccttgggcaagctgcatgtcttctggtgactcacttttctcagttgtggtatggaaatatcccgcttccccagttgtgaggaccaacgagaattactagtcaggtggaggggcttagcacggtgcctggtgcctggtaaacctttacctggtagccattgctgttattcatttatttatttattttacacaataatttacttattgagagccttctctccccgcccttgcagtctctaggtcactttttccacttgtagattttgtgcccaagccccagaaagatggctgggggcaggggctctgcgtactattcgatgagacccataacgtggctgtaactgtctttctcatactgcaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgcttttcttgggcataaatatctgatttctggtttccattcggtctttttttttttttttttttgagacggagtcttgctctgtcgcccaggctggagtgcagtggcgcgatcttggctcactgcaaactccacttcctgggttcacgccattctcctgcctcagcctcccaagtagccgggactacaggcacccgccaccgcgcccggctaattttttgtatttttagtagagacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttgtttaaagagacagggtctcgctctgttgcccaggttggagtgtagtggcacgatcatagctcactgcaactttgaacccctaggctcaaagcagtccttctgcctcagccagtcaaagtgctgggatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacacagcggtggtggtggtttggtttatatttatgaccttttaaaagtgtttggcattttcagggaggtttgttttttgttttgttttttgaggctcatgttgcccaggctggagtgcaatggtgcagttctcggctcactgcaacctccgcctcctgggttcaggggattctcctgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaaaaagaaaaaaaaaggtcttctatcgtttctccactcaaagacagctgttaacattttattgacttctatggagtttgccctatgcttctgttttatgtaatagagacagtgctgtagtgaatagcttcacgtcaacatttttctataattttctgaagttagagtcttaattattggatcaaaggaagtgaacatttttaaacctcttgatacatatattaccaaattgtttgcttttccgttttttttaataaatagagatgggggtctctctgtgttgcccaggctggtcttgacctcctggcctcaagcgatcctcttccctccacctcccgagtagctaagattataggtgtgagccaccatgctcagccgctgattttaacttgtatgttttaaacaaaatttctagtaaagtagaacatttctttgatatgtttgtgtcaggatttgactctcccaggtctttggagaggctttctaacaaggcatcccccgtgggtggccatctgccctgtgagaaggtcatttctagttccaggtcacgcacagtgtgtcagctggtggggtgtggagtttcaggcccaggcctcctggaaagtgcccgaaagagaaacggcttagaaaataaggactttaacggtggtgtgggttgagtttggaaagtttagaccatgttagtggaatcagagctgggaagaggttctagaagttacctcctctcactggtttccagtccacacttctcagaactctcccattttgcagtcaggtgcagtggctcacatctgtaatcctagcacttgaggagaccgaggtgggcagatcacttgaggccaggagtttgagaccagccctggccaacatagcgaaaccccgtttctactaaaaatacaaaaattagccaggtgtggtgtggtgcacacctgtagttccagctactcaggaggctgaggcatgagaatcacttgagcctgggaggcagaggttgcagtaagccaagatcgcaccactgcactccagcctgtgtgatggaaggagactctgtctcaaagaaaagaactcacctattttgcaaaggagcttcatggttctcttgaagaaaaataggaatggaggccacctctgtgtcaaaaacaacatcccacatttctgtgtttcactttttttttttttttttttttgagactgagtttcactcttattgcccaggctggagtgcaatggcgcgatctcggctcactgcaacctccacctcccgggttcaagcgattctcctgcctcagcctccctagtaggtgagattacaggcatgtgccaccacgcccggcaaattttgtatttttagtagagatggggtttctccatgttggtcaggctggtctcgaactgccgacctcaggtgatccgtgcctggcttacttttttttttctttttctttttcttttctttctttctttttttttttttttttaagagatagggtcttgctatgttgcccagactggtctcaaacgcctggcctcaagtggtcctcccaccttggcctcccaaaacgttgagattacaggtgtgagtcaccacgcttggcgtgttttacatgttgacggacagcatataatcacatgtataagggtttctgcttgtaaaagtctggaaacccattctaactgccagaatcacaaaacctagagaaggggacataactgccctgtggccacccagtagcttttatcttctctcgcgacggcagaggcaggacagccagcattctggtgaggattgaaggattagttgtaagagatttcagcaggtctgcagtgatcagatgggtttctcacatattgttaagttgaaagtagccgtggctcagtatgagttgagtacctgtttaaaatctgcattcaaagccttcttcccagaggccacaactgcagtgagatccaagtgtgtggctcacccgccccggggctcacagctgggcagggtgatttccactcaaattcttgtgccagtgcagatcttgttctaaagcttttctaaatgcctggagactagaaagacttttggatacttttccctttttcttttggatgaaatttcatctccagtagaacagcagcattccatggtgcctcagccacgatcctctggagagagatttgcggcgaagacctgacgagagactgtaaaggaaaagcagggtttgtttttcctggtcaaagttgttaatactaaaaaaaaaagaagaaaaaaaaactttggccaggtgcagtggctcacgcctgtaatcccagcactttggaaggccaaggcaggtggatcacctgaggtcaggagttcgagaccagcctggccaacatggtgaagccccgtctctactaaatacaaaaaaaaaaaattagccgggcttggtggtgggtgcctgtaatcccagctacttggaaggctgaggcagaagaatcgcttgaacccaggaggcggaggttgcagtgagccgagatcacgccattgcactccagcctgggcaacaagaatgaaactctgtctcaaaaacaaaaacaaaaacaaaaaaaaccctttgatcattaaaaagttatatgactattttagaacatttgcaagtacagaaagaggtaaagaaagaatagcccaggtgcagtggctcacacctgtaatcccagcactttgggaggctgaggcgggtggatcacttgaggtcaggagtttgagaccaacctggccaatgtggcaaaaccacatctctactgaaaatacaaaaattagccaggcgtagtggtgcgtgcctgtaatcccaactacttgggaggctgcagcaggagaactgcttgaacccgggaggcggaggttgcagtgagccaaaattgcactgctgcactcctgcctggcgacagagcaagactccttctcaaaaataaaaaaaagaaaaaaaatcccataattctttgattccagtgacattttagtgttgttctttccagacttttaatttttaattaatttatttttatgagacagggtctctgtctgtcacccaggctggagtgcagtggtgcaatcatggttcactgctgcctcaacctccagggctcaagcaatcctcccacctcagcctcctgagtagctgatactacaggcacgcaccaccacaaatggctaatttttctagtttttgtaaagacaggcttttgctgtgttgcccacgctggtcttgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccccggagcagaaggctcacccctcctttggtgtttcagagcctctgggatattgggcacctgaagaactgcagccgcagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtgggtatcaaaggtggcgggcttggtgtgagtaggaacagtggctggtcatggaggggcttgtgtgccttgtcatcctctggagtctccagtaccctcctagggcctgggccatggcgcgccctccattggggaggctgcgtgccttcgtggaaagttttagctgaagtcctcgcctatatttcccaggctgttttgcagagttgtgagagttggttcatcgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcctgcccgcccgcccgagggcactccaggtctgatctttggggcgggttgtgggcttttgtcggaggaattggcagctccgtggcgggcctggcacccacagagctgccaattcctgtgttcggagttgttgcaggcctgactcacctgtgttctcatgctgtgtactcagggctgcccttgtggccgttcctccttgagactgaaagggtgggcaagtgctaggggtgaggggccaggagaggcagggaggccaagatgggttgactctctgctgtatgcctagtgctgtgtgggcaccttatacacacccgtctgtgttatcctcatgaaaaacacttaggatacatgttgataactgcattttcccaaagaaagcaagcttggcgagcttagatacttccatcaagatgatacaatagccaggcatggtggcgcgtgcctgtagtctcagctgggtgacagagggagacccctgtctctacaaaaaattaagagatcagttgagtatggtggcacatgcctgtagtcccagctgctcgggaggtggaggcaggaggatggctttagcccaggaggccatggggctgcagtgagtggtgattgcggccactgcactctagcctgggtgacagagtgagactcggactctaaataaataaataaatgaataaataaataaatgtcaccttttattaagtagtgtatgtgtgaccttgagttattcaaccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgagcatacacatcatattttatccccattttgccaatgaggaaactgagacccaggtagttacagtgacgtcctcatagtcgcgtggcttgtgataagatggggaccctggcttctggtgtggtcccagactgtactaccccagcaaggtttcagtgagaagggtaagaccaccttccctggaagggagacagatgtggagcagcacctggaaagaagcaggcctgggctctggcatcagtgtgcacacacactgcatcagctctgatttttttttttttttttttttttgtagaggtgggacctcttgtcactgaggctggagtgccttgggattatagctcactgcagcctctaactcctgggctcaagccatcctcctgcctcagcctcttgagtagctgggactattggcatgcacctccgcacctggctaacttttaaattttctgcagagatgggatctcactgtgttgcccaggctggcctcaaactcctgtgctcaaaccaccctcctgtcgcagcctccctaaacactggcattacaggtgtgagccaccacacccagtccccttgacctctttcagccttggtttcctgtccgtaagtgggagaaatgtcaccttggcagtctgtgcagcttaggagagacaagtacatttgatgttggttactaaatgttggaccctggaccggcactccaacagccggtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgagaccagcctggccaacatggtgaaaccccgactctactaaaaatacaaaaaattagctgggcgcagtggtgcatgcctgtagtcctagctactcgggaggctgaggcaggagaatcacttgaacctacgcgggaggtggaggttgcagtgagccgagatcacacgcctgggtgacaagagtgaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggtggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctaggagtttgagaccagcctgggcaacacagacatcatctctacaaaaagtaaaaaaatgagctgggtgtggtggtgaatgcctattgttccagctgctctggaggctgagttgtgaggattgcttgagaccaggagtttgaggctgctgtgagccaagatcacactgctgcactctagcctgggtgagagagtgagaccctgtaaccaaaaaaaaaaaaaaaaatcagctgtggaaaagcatcacgtgtttcccctgcgctgaggctgactctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggtaagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccgaccacagaggttgaagggttcctttggccggcaggccagcatggaggtggtgcgtcataggagttcagagggccctgtcccaccactcagtggctgtgtgccctgggcaggcaactgcgcccctctgcgtgtgtgcgtttctgctttttggtctgcgatgtgttttgatcttttttttttttttttttttttttttttgagacggagtctggctctgttgcccaggctggagtgcagtggtgcaatctcggctcactgcaacccctgcctcctgggttcaagtgattctcctgcctcagcctcccgagtagctgggattatagacatccgccaccacacctggctaatttttgtatttttagtagagacggggttttgccacgttggccaggctggtgtcgagctcctgacctcaggtgatctgcctgcctcggcctcccaaagtgctgggattacaagcatgagccaccgcacctggacctgcagtgtgttttgatcagtattattgagaatgaggcaccagtttcctctcggagccatcccttactctaatctggtggttgtcactgggggtgattttgtccccggggccatctgacaatgtttggagacactgttggttgttacagctgagtgggtgggaggtgggggtgctcctggcatctggtgggtggaggccagggatgctgctcgccatccggcagtgcactgggctggccctgcagtaaggaattattggcccacagtgtcaccagtgaggaaacttgagaaactggtttttccttttttttttcaattttaattttagttttattttaaaaagtatgggttttttttatcgtgtttgtttgtttgtttgtttgttttttgtaaagactgggtctccatcgccctgtgttgcccaggctggtcttcaactcctgagctcaagtgatcctcctgccttggcctccgaaagtgttgggattacaggcttgagccgtcatgcccagccctggaaactgtgtttccaggagtgtcgtagagtctgtgaaaactgtggctgtcagtcagctcccaagtcattgccttcacagtgtgtgaagtcaactgacaaagatagcagacaggataaataataacatggaaattgcatatcgtggcagagagcaggaagtgttaatcggggaatgaaagtggcaggtgttgtagaggtcgatttgaagttaggtgggtgtggtgtcatgtgcctgtagtcccagttatttaggaggctaaggcaggaggatcgcttgagcccaggaggtcagggtggcagtgaactatgatcacatcactgcactgcagcctgggtgacaaaggggtaccctgcctctaacaataaataaataaacaaatagcagcatgactgtgtacctactgtgttcctatttgtttattttggcggttgaaaaaagaatttgaacgttccctgtatcttggggatgctagcagactaacctttggttttcctttgaaaacaggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcaggtatcgtgggcaacggccgctcgttttgtctgccctgtgtttctgctcttagctgggaagactcaccccaattcctgcagatgcggctcctgccccctaggtggtcctgccgtggcatctcatttgcatgtggcatgtgggtgccgaggtgccgtggccgtccagagcctacctgaccccttgtacctgagtcctggcagtcaccacacgggttagaatctacagtcctttcactcacgatgattaagggcctccacatggagcagttaaaggcctgtggcctctgcttgcgggctgcatggcgagcattgtgcccgagaacactgggtcactgcctgtacactgactcccgccttgtgccaggccctaaggacccagagaccagagtatcagcccttacccctgagccctagtctagtgcaaggggctgtcagcgcggtgtgagggagggcagaatgtggagcacgtggcagtggctgcaggtggcacgggtgacctggcccccgtgatgatgcagcccagcccagagtgcctggtagagcgctcagctccttgagagagagagagaatgataccacgggcccagtgcagaccagagcgggtggcatttaaaatgaggagattggtcaggcacagaggctgacacctttaatcccagcactttgggaggccaaggcaggaagatcatttgaacccagcagtcagagaccagcctgagcaacatagcgagaccccatctccacaaaaaaaaatttttttaattagccaggcatagtggtacacacctgtaatcccagctacttgggagactgaggcaggaggattgctggagaccaggaggtcaaggcagcagtgagctgtgatcgcgccactgcgcttcagccccctaggtgacagagcgagaccctgtcttaaagctgggcccagtggctcacgcctgtagttccagcactttgggaggccgaggtgggcggatcacctgaggtcaggagttcaagaccagcctggccaacatggtgaaaccccatctctactaaaaatacaaaaattagccaggcatggtggccagcgcctgtaatcccagctacttggaaggctgaggcaaaagaatcccttgaacccaggaggtggaggttgcagtgagccaagatcgtgccactgcgttccagcctgggcaacaaagagcgaaactccatctcgggggaaaaaaataaaaaagataaaatgaggaacccccccaggatttccctggatttggccaaggtgaatgggctggccgtagccctctgactgtctgggtgacttggggcttcgtcattcattattgagaatgttgggcttggagcacattttgagaattcagagtggtagctgggacagggctttctgagagtgccctggtgcgggtggtgagggagtgggtgggcctggggccgccctggtcccagggaggaaatcatctcctttctccgcactggccctggtcggcatcctgctgcctccctgctcaccggcccacccctgcccaccgcagccacatcaagggctgaaacttcacagggtggttgagaccgccttggcagcttcttggacctctagtatttgttcagactgggtttccgaggaccctgccagcttgtgtaagacacagtgacagcgcctcccgctcattggttcgtgtcatgtgccaggccctcctgagcaggctgcttgagtgacttcactcatcccacgatgctctcaggctgagcagtgttcttcgcttacaggagagcacattcaggcccatgaggttggcgacacagccagcaagtagcggagctgggattcagcccagaccccaagagtgggctatctggggcacatggggagttattgacattcccgggaaggcagggggctcttttaatacattttaattttattttattactatttttaaagacaaggttttgctctgtcacccaggctagcgtacagtggtgcaatcatggttcactgcaggcttgaactcctgtgctcaagtgatcctcctgcctcagcctcctgagtagctgggaccacaggtatacaccaccacacccggctaatttttcagttttacgtagaggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttccggggcatcttctgccaggagttggggcacgtgcatctgagatctttctgggagttgggagtataggaaggtgtcatcggggctctctgaggacatagacataggcaagccaggctcagggagatgctcccccaacttccctccctgagtatctgggtcagcctgtttcagagaacagtgtgctctatctgctggcccaggagggttcttagaggtgctgggacttctgtcagccctgttccactcagcttcctggagcttcttaagttcttaggaattattttgaggcaaatttctagatagtgctagagctgggattctggagttaagtcatttaatgtggatttgttcctttctcctggtattgggcctcgttggtctttcctaaaccatttccgtttctcccagtatttctctggggtccccgtccctggcctgagggcccccagaagtgctgatgtgggtcctaccggtgtgggccaggcaagttacagaaaagaaggtggatgggccagtctgtcttcccttggtgctggggtgggcatgctgtggcttgccccacgttgtaagtcaggagggaaccaggccagcaggctctgttagtggaaacagcctcaaaggggcctgcctcctggggtaggtgtaggtgcatcctgattcctttggttttcttggagctgggagaggtgtaattcacctgcacgagcctatctacgcgctgaaaaacaggcttttcccctgcctgatttgtagtgaggccccctgcagttaaccctcctctgacggatgtagagccagatggggcttagtaaatacctgacctcttaacctagcaggcggcaaggttctcacagccaagtgcatgtcaacagcatcaggtgaaagttaccttggatgtgaggaggcaggcagggcaggcagggcccgtctagagccagcgccatgggctggggaagcccgagaaccgactttttactggcagccactggaaataccatgtgagcgcgtgaaattgaaaaatttcctggaactcacgtgcacagcttccacgtgccccctgggaacaggccgtgatacaagaaagcgtgtcatctggggctgagctgctgggtggcagtagatttcctggtagctgaagttgatccctttaagcaccaaaacttgtgttttaatgatgttggatggaaatctttcctaaatgtgtcatgcatgctcttgtctcccttaatggagagagtgtgacactgcttagcacttggatggcttggggtggtggttatgaccagcagtctgtcacagctcagcgaggtgaagcctgtgggcgttttgctctgtgctgaatggctcagtggccctgcaaaacggcgctcagctcttggtggctttctgttgtggtgggctgctgctgctgctgctgctgctgctgcccttgcctctaaaagaactcacttcctcttcctcctgctgccacctgtcttttggcttgtgggattggagtcatggggcccagatggagccttgctcctgacttatgataggccctcggtctcttttcttctctatttttttcttctttcttttctttttctttgttttttgttttgttttgttttaagagacagggtctcactctgtcacccaggctagagtgaagtggtgtgatcgtggctcactgcagcctcaaactcctgggctcaagggatcctcctgcctcagcctcctgagtggccaggactacaggcttgtgccattgtgcccagctaattttttaaattttttgtagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcaccactgccctggcggcctttgggaatcatcctcacaggtagaggaattgaggctcgggaaggggacttgccatgctcagcacacacggctttgagcgggagcatacgcctctagcatcgtctccagcctctgcagctcatgggactggctgccagccccaatcccagagggtgtggacttggagaggggctttggatctccttcctctccggcctcctggctttgcccctcgccctgcatagaaaactcggagtcctcatgtctcacgtttcccactctgtctgggatctcctggagatggtcacagacaggaaagccagggagggcctaataggtggaccaggagttggggagaggaggagggtgcctgaggccatgactatagggacttctcagagaaggacacttcaggaggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctccattcacagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatacaaaaattagccaggcgtggtggcgggcacctgtaatcccagctactcgggaggctgaggcaggagaattgcttgagcctgggaggcagagaggttgcagcgagccgagatcacgccactgcgctccagcctggatgacagagtgagactccgagaaaaaaaaaaaaagtggggggaagagttgaaaccagctgaggaaggggaggagcttgctccaaatgaatgaaactgagtgttcagtagagtcaggaccttgacccaggtgtccagactccctgcccttcttagcattatcagggcccccagatccactaccagccttgcctttggatcgggagtaggcaaggagagcaagaagctgctctttgcttagcacggccacagaggcaatcctgtttgagaacagtcaacaaacaaactcaaacaggccatgcacagtggctcatgcccataatcccagtgctttcagaggccaaggtgggaggatctcttgaggccaggagtttcagaccagcctggacaacatagcaagattctgtctctctctctatatatataaaattagccaggtgtggtggtgctcacttgtagtcccagctactcaggagggtgaggcaggaggatcacttgaacctgggaggtggaggctgcagtgagctatgatcgcaccattgccctccagcctgggtaacagagcaagaccccaactctgggcccagcatgcttccagtgtgtcactctaccggcatgaccctacctcttaaaaaaaagaaatatgatgacttaagaccaaatgagtggccaggtatggtgtctcatgcctgtaatcccagcactttgggaggctgaggtgggcagatcacctgaggtcaggagtttgaaatcagcctggccaacacggtgaaacccctgtctctactaaaaatacaaaaattagcagggtgtggtggctcatgcctgtaatcccagctacttgagaggctgaggcacgagaattgcttgaacccaggaggcagatgttgcagcgagccaagatcatgccactgcactccagcctgggccacagaacgagactctgtctcaaaaaatccaaagaccaaatgagtgacttgaacataatcattgtagggaacacaaccctcatattaaaaaaaaaaacaacaacaacctttattttatggtaattaagttccggaaaagttaacaaaagtagttgggtttccatatctccctcatctggcttctgacattaacagctttcataaccatggttcagttgtcagatccagaaaattaccactggttggctgggcacggtggctcactcctgcaatcccagcactttgggaggccaaggcaggcggattacgaagtcgagagatcaagaccatcctgggcaacgtagcgaaaccccgtctctactaaaaatacataaattagccgggtgtggtggcacgcacctgtagtcccagctactcaggaggctgaggcaggagaatcgcttgaacctgggaggcagaggtttcagtgagccaagatcacaccactgcactccagcctggtaatagagcgagactccgtcccctcacccccgcaaaaaaagaaaattaccactggtataatactcttaactaaaggttttttttttctttcttgatttttcaccaatttcccactactgtcctctttctgtcccaggatccaatccagggtcccactttgcttccagttcttattctccccgtcctcctctgggctggaacagtttgtcagtctttatctttcataaccttgttactttcaaagaggtgctttgttgaatgtcccttaatttgagtttgtcttgttttcccatgtttggacaaagataatgccctttgttatttcttttttgacagagtctccagcctgggctggagtacagtggtgagatcatagctcactgcagccttgaactcccaggctcaagtgatcctcctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgatcatttgctaaagtggtgtctgccaggatttttctcctctaaacaggtgctatgagaacctgctttttttttttttttttttttttttttttttttgagactgagtttctctctgttgcccaggctggagtgcagtggtgcgatctcggctcactgcaacctctgctgcccgaggttcaagtgattctcctgcctcagcctcccaagtagctgggattacaggcgcctgccaccatgcctggctaatttttgtagttttagtagagacaggattttgccatcttggccaggctcgtgttgaactcctgacctcgcgatccacccaccttggcctcccaaagtgctgagattataggcgtgagccactgcacccagccattttttttttttttttttgagatggagtcttgctctgttgtccaggctggagtgcagtggcacggtctcagcaacctccacctcctgggttcaagtgattctcctgcctcagcctactgaatagctgggactacagctgtgtgccagcatgcccagctaattttttatatttttagtagagatggggtttcaccgtgttaggatggtatcaatctcctgaccttgtgatccacctgcctcagcctcccaaagtgctgggatttcaggcgtgagccaccacgcctggcctgagagcctgcattttgatgacactagtgagtgtaaaatatctttttttttctttttattttctttattcacaacaggtatgaaatgattgttttcagagtcttttttttttttttgagacagggtctcactctgtcgcccaggctggactgcagtgatgtggtcatggctcactgcagcctcaacctcctgggttcaagccatcctcctgcttcagcctcccaagtacaggtgcgcaccaccacacttggcagacttttaaaaatttttttggagatggagtctcactatgttgcccaggctggtctcaaactcctggcctcaagtgatcctcccacctcatcctcccaaagtgctgggattactggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccagggagcgtccctgccactgtgcccatgcagatgccaaagcccagcagagtccagcaggcgctcgcaggtaggtgcctgccctcgggctgcagagcagtctgtgccctgcgggacttggtggggaggaaattgtgatgtggggccttgtcaccctctggatcctcagggagagccagaggggctccctgggggagcagtgcctctttctggtgatggtgtcaccccagagtgagcccaggtgcccctccttttgctctctgggtacgtgggcctgatgacggtgggcgctcgggtgcagaccttttcacatcctttaacatttttgcattgaattgcattatatttaaatagtcactttcctgtcctgaaatactttaaacatttccttaaaggggccctctggggaattaatagatctatttcggctgtagttactcttacatcttgaataagaggcaccttttgggtccaaccagatcttttgctgtactaaccatacatcttacatcttggaactgttttgggtttggtttggttttttgtgagacaagagtctcgctctgtcacccaggctggagtgcagtggcgctaacccagctcactgaagtcttgaactcctgggctcaagcaatcctttcaccttaaggatccttaaaaatacctactgctggcccccacacccattctgttttagcagcctggctagcagggttttcagaagctccacaggtggcaggattttttttcttttttctttttttgagatggagtctctctcgcccaggctggagtgcagtggtgggatctcggctcactgcaacctctgcctcccaggttcaagcaattctcctgcctcagcctcccgagtagctgggattacaggtgcatgccaccacgcccgggcaatttttgtatttttagtagagatggggtttcgccatgttgaccagtctggtcttgaactcctgacctcaagtgatccatccgcctcggcctcccaaagtgctgggattacaggcatgagccaccgtgcctggccattttttttttcttgttataagtgacaggatcttgctctgttccccaggctggtgtgcagtggtgtagtcatagctcactgcagcctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctgccacgcccagctgaggttattttctaacttctggaaagttcgaggtatgtaaggaggtggatggcgccatcgttgttcacagggtgatgtggcggaattcaataatgagttggtgttttaggggagttgctgtcgtagtggctgagaggggacaggcctggaggtagggcggctggtgcagagcctgacctcagacctgggggcaccagccaaggcctgaccagcttcgaggcagtggagttgagggggaggtttggcttgaaacattcagaggcatgagccgtcaggcggggggttgtgaggggggattgggggtagactgaggcctgctggagtgcagccagtgacaactgaggagcagcctggggcttggcgtgtgtgaattcatttcgtccttaaatcactgaggtggaggcttttgttcccattttcattagaggaaactgaggctcggagaatttaaaaattctctgccagcccttggcagagctgagacacagccccgggccttcttgcctatgacggttcagtgctgctgagtctagggggaggttgggagggggtgatggctgtggagtggccgttggagctgttccggggcagtgggatttggctgtgggcctcagaagagcagtcttgggtggaatggggtgcccctgacccctcgtgggagcgtgtgtgccacagagaccgtgggcgggactgaagagaaaatgaaggagcggccagagaggtgggggcaggagggagaggagctggagcggggcaggggagacagaatgagcaagacacactggccagaaagtccctgctcactgaagtcaccgtgcggcgccgtagggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctgagtgccctgggtgtggagttagcacctgcccccttcctctgctcttgaggctgaaggtcctgtccaggctgtgtcccaaattgtccatcctgttgtctgtccccgttgctctcagagcaatcctggagctaaagcaggtattttaacatccattttacttgtggggaaatagattcgggaagctggttcaggcctaaggaaataggagagcctggaggctgtgtggactcctgcctcccccaattcaaggcccagtgttggtacctactgggggagcattgtctaggggagcagggaatgagaggagcctggccagcaccccggagccagagctggagagcagtgtcctgtcaccctggtgtgcttgtgggttgaggaattataccatgcccggctgcggagatgagcgtttgcgcacagggtttttgcagggaggtttataaccaggaggtcatgctttggaaggactgagtgctggaggcactgcttccaagtgacagtgcctccaggtgacagctcccctggctgtggcatagcccagtccctctatcgggtgggggcagggactgtgaggctggagccagggtctccacccctcacctggtcacagcagcggtccatccacagctcacactgctgcctggggcagggatgggtgtcagcagcctgcccaggactgctcagctggtgagggctggcactgggctcgaacccaggctggggaggtcagagcgcacagaggagaggcttggatctcagccctggccctgggtgtcagaaggaggggtgtctgcaaattggaagtgagaatcagtgagtgggggcttcactcttcagggctctgacagcgggaatcctcccagatgggtggagaaaaaggctgtggccctccgagttattcaggtgatttgggggctgtcaggagtttggggggttgtccctagccctcctcctctccaggcttctgggttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagtacggcggggcgggaggcttggagggacaggccccgtcaggcagtgttcagggaaggcctgcccgccgaggcagtgttgccggagaaccctgggtagggagacgtgtcctggcctttggtcctcccagacgacgtgggcagcgcagaggcaccaggttctcttgaggaaaattgcacctgtccctgtcctctcccatctgtctgccacccgcgcccgcttgtccttctctccacccgacattcagttcccacaggaaccgcatttgagcccaggaacaagcttgggatgttgggggcattgagctcccgggctcaaacctctgtcctctgatgcacgctttggtgtctcctgctgagcggccactgcaactcaccctgcccacctcggctctgctgcccaggctggtggctggtctccgcttctgtccccacagccaggcacatgtgccgggttgagaagctttgttcttctagtgggggcgcagtggctggcctggccgcccttcacccctgagtcacgccatctgttcctggatggggagtggggtccaggaggactgggatctctaccaactcccccggcagccggctgtgcccagctcctgagccaggttctgcagaccctggaagccaccttaagggatggctaagaagctctgggcttcccctttctctggagaggaggtgcttttgacctaactgaccgatgacagggaggaccggggagctggcactatggaaagtggggtaggccgagggtgtggcaggaacgggttcgtccagcaggacacgctgtgtcccaggaagcgctgggtcatcagggagcacgaaggaagcagtgtcagaggagagtcccccagggcaagtgtggggttccctgcaggcatccggcagtggtgagctctggaaagagtggccggtctgtcccagcatagctgctggccacaggcccacccttgcccgagggcgccagagccacagcctggggccttgctgcagcccagccctcacagtatggggatgctgcagtgtgggagcaggcccaggggccacgttcctgcccgcctaccccagcgctgtcgctgaaggccctggcacccagatcagccaggaggggcatggagcacacacagcgcccagtggaggctggaggcctagtaactccaagccaggagggcccagggcctcctggggaagctgagcccttggagccagccccacccaggagaccccgtgccccgggcggcttcctggagtggcgtcctccgccctctgctctcctgaagtcacgggtcctgccccggtgcccacctgcacactgagggcacgggcttgtctgttgctcctatagaaacctgtgggctctggggccagggctaccatgagccaggctgccccaccctctgattcctggcctgggtagtccccagggagacctgtgcgtccccgtggccattgatggtgtcacatccttggcctgagcagggtttgttggcgtcacatgccgaaggagtcttctaatgtctctccctctctgcgtgtctgctctcacgcccgtgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggtagttcttgttcccaaaagctctctggcctttgctaagcctccttccggcctcgctgcctccgactcttctgcacagaccctcttccttctctctgctccctgactcctgggggaaggggctcagtggcccttctccctgcccccgctcggcagcagaggcggcccctggaagctgactttccaccgcagccccagagttcagctcctctcctccagtcacagctggcatgagggggcttgttcttgaggactttgtgatttttgtaagcagcaagttgtgggtgagaggcggcgcccggctcaggatgcggggacaaccgtcccttccgccagggccagcacgtgtctcgggaaaggcccccagacagcggcccaggtctgctgcccaggtctgctgccctgacccccagccctgtgtggccgccacgtgggctgcttgagaggggtccctcggtgacccctgccctgctcgttgcatggccacagaagaaggggctttaggaccacagcaggtccagggagttacagcaagacctgctcggagcagcctgtgatggtcaagttctgaacctttcccaagcgggtgctggccctgcttccacccctgggctgtggaagtgtggactgtggccagtccagatgctcttgagtgggcgtggtggcgggcagggagggtggccgtggccctgctggccctcagtgtctgtgtcatctcagcaggtcctctcggagcctccgcttagcagaggggcttggcgaggtctaggaaatactcgaagcgcctggcatgcggcaagggtggcttccgatcgtgtccgacctccagcccacaggcgaggaggtgggctcagggaggggtgggcctcgagctcctgcccccagcccagggctctgcacgccctgcccttcccctgccctgggggaggagccagactcgttggcagcccggctggcaaccttctgtggcactcgggtttacctgggaaggacacgctcttggtgggtcgcctggctggccccttctgagacacgtggctaatggaaagctcccttctgttctgaaaagctgcaagggctggggtgggtgggcgggggtgggatgctgtgcccggcctcaccagggctgggcagaggcgaggcccaggctcacccggagatggctctggagttggcaggcttttccaaaggaaaaggcccccctcagcctgagtagggcattccagccacacggagggtgaccctgagctgggggccatcgttctggtctggcgttctcgccaccgtgacaggatttgggttcgggcagtctgtatgggtgtgtggaggtgtgggggtgtgtgaggtgtgtggaggtgggtgtgtggggtgtgtagaggtgagggtgtgtggggtgtgtggaggtgagggtgtgtggggtgtgtggaggtgtggggtgtatggaggtgtggagtgtgtgtggaggtgtgtggaggtgtggggtgtatggaggtgggtgtgtggggtgtatggaggtgtgaggtgtgtggaggggtgaggtgtgtagggtgtgtagaagtgtgtggggtgtgaggtggggtgtgaggtgtgtggaggtgggtgtgtggagctgtgtgtggtgtgtggaggtgtgaggtgtgtggaggtgtggggtgtgtggagctgtgtggggtgtatggaggtgtagggtgtgaggaggtgtggaggtgtgtggtgtgtggaggtgtggggtgtgtggaggtgtggggtgtgtggagctgtgtggggtgtatggaggtgtaggctgtgaggaggtgtggggtgtgtgaaggtgtggggtgtgtggaggtgtggggtgtgtggaggtgtgggatgtgtggggtgtgtggaggtgggtgtgtggggtgtggagatgtgtgaggtgtggaggtgtgtggtgtgtggaggtgtggagtgtggggtctgtgaaggtgtgaggggtgtgtggaggtgtgggagttgtgtggcgatgtgtgtggggtgtgtgtgtggaggttggtgtgtggaggtgtgtggtatgtggaggtggggatgtggggtgtgtagaggtgagggtgtgtggggtgtgtggaggtgcgtggggtgtgtggggggtgtggaggtatgcggtgtgtggaggtgggtggtggtgtgtggggtgtctggaggtgtgtggggtgtgtggtgtgtggaggtgtggggtgtgtgtggtgtgtgtggacgtgtggtgtgtgtgtggagatgtgtggtgtgtggaggtgtggggtgtgtacaggtgtggggtatgtggagatggggtgtgcaggtgtgtggaagtgtgcaggtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtggggtatgtggagatggtgtgtggaagtgtgtggtgtgtgcaggtgtgggggtgtggaggtgtggggtgtgtggaggtgtggagtgtggggtgtgtggagttgtgaggtgtgggtggagttggtgtgtggtgtgggatgtgtggaggtgggtgtgtggaggtgtgtgggatgtggaggtgtggggtgtttggaggtgtgtgggatgaggtgtggggtgtgtggaggtgtgggatatgcggggatgtgtgggaggtgtgggtggagttggctgtgcgtgggggggtgtgggtgtggattggggtgtgtggtgtgtgtataggtgtggtgtctttaggtgcggggggtgtggattggggtgtggtgtgtgtaggtgtgtctgtaggtgggggtgtgggtgttggtgtgtgtgtggaggtgtggggtatgtgggggtgtgtggaggtgggggtgtgggtgttgtgtggggtgtgtgtggggtgtgtggaggtgtggggtatgcggggatgtgtggaggtgtggggttgtgggtggagttgggtgtgtgggtgtggaatggagtgtgtggtgtgtgtataggtgtggtgtctttaggtgtggggggtgtggattggggtgtggtgtgtgtgtaggtgtgtctgtaggtgggggtgtgggtgttggtgtgtgtgtggaggtgggtatgtgggggtgtgtggaggtgagggtgtgggtgttgtgtggggtgtgtgtggggtgtgtggaggtgggtatgggggtgtgtggaggtgtgggggtgtgggtggagttgtgtggggtgtgtggaggtgtggggtatgtgggggtgtaggtggagttgggtgtgtgtgggggggtgtgggtgtggattggggtgtgtggtgtgtgtgtaggtgtggtgtctaggtgtgggggctgtgggtgtggattggggtgtgtgtgtgtaggtgtgtctgtaggtgtggggggtgtgggtggaggtgtggggtgtgtggatgggggttggggggtgtggtcttgccagcagtttccctccaggtcacagcagccatgccatcacagcaattccagcttggttacatattcgtctttcccgtttgagatcagggaaccgaggctcagaggtggcatgattcgttcacagcaagagaactagaattaaacaaactgtgccgactccagcctccgccccaccacgccacctccctgccaaactgtcccctccctggccctttttggtgtaaagggagttcagcaggtgcagctgtgcgccctcaggcttagaggcttagaattctctgcagcacctaaaggccgtgagcttggattcaaaccagagccccttctggtcctggagtctgggacgaccgcagccccaccatgaccttggggtggagcccctgtcaggagcgcctccacgggtggcactgggctccccgtccctctttcacccccgcacgggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaacaactccacatggaaaggacatccgccccatcttgcttgaagggtgcttcccaggtgcctctgggtgccagggccttgctccagcccctttggtttcatctcccagcctcccgagacccacatcgttatgatctgagctttgcacttaaggagctgtggtcctgagcaaagcccctcctctcccggccctggcctctccatagcctgatggccatcctgggagcaggaattccagagacaagggatgggccagcctgccccactctccaccttgcggatgctggtgtagaagtgaggtggcctcgtccaggtggctgtcctgtcccccggctattgggagagctggtcaaggttcttataatttttttattcttaaagacgggtgcacactgtcacccaggctcagtgcagtggcgtgatcacagctcactgcagccctgtcctcctgacctcctgtaatgaacaggaccaatcagactcctattgcgcttccatagaacctgaacctctgctgagccacgttttgggggctgcagcaccactttcccctgattttagctgggagcccgggagatactgttgggggagggggtgggcgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcgtcctcatgtgtcccaccccttccacaagcccttgccacattcccgcctgcccagcgctcagctctgtctcggccctggtgtccatctggtgtgactgggccgtttcaccccaggctcctcctctccaagctgccgtctgcacagccagcacgcagcttggatcatgggagcactccctgcctggaacccccagcaggacccccaactcacacacaaccccaagcccctgagtgtggcagccagacccccgagggcgcgcctctccctgatcctgtctcatctcctgctcccagcccaccccctgccagctttagtgcccatgcgctggctcctcgttcagaacgtcctcctccctcttccgggtgcccactctgtgcttgtccatctggcaattcctgtctcccttgtaagaccccactccgagggcctcccccaggatcctgccctgtccgtccttcccatttggtggcttctgctgtcatgtcgggcctgtgctgctggtaagcccttcaagggcacaggtcccggtgactcacctgtgtctccagcctgtggaatggactttttttttttttttctgagacggagtctcgctctgtcgcccaggctggagtgcagtggcataatctcagctctgcaacctctgccccctgagttcaagtgattctcttgcctcagcctcccgagtagctgggattataggcgcctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctcttttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaactgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcaccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatggcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattcccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctttccatggcccgtgtcaatgccggtatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgtattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcacctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctgtacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccttgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcaagcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttggtgctcaggggcaccaccaggagaggcctccggctgaggtcagcttcccagagaggaaggtaagggactgtccctagctcaggactggcacccaccctgcagagagccacgccttcctcaggagggctctgctggacagagacctgatcaagggcgtctcccactccttcaggatggagacaaaagcccaactggtggccgagagtggtggcttatgcctggaatcccagcacactgggaggccaaagcaggaggatcacttgaggccaggagtttgagacgggcctgggcaacatagcaagaccctcgtctctattaaaaatataagaaatatgccagacgcggtggctcatgcctgtaatcccagcactttagaatgctgaagcaggtggatcgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtctcaaaaaaataaaagaaattgaatacattgatattttgccaggaccctgccttctacaggcatctagtctaatgggactggcagtaaccaaggcagatgagctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaagaagcagtgaagccgagccaggaaataccaagatggcgagccagtgtgcttgtagagattgtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcgagtgatgcgagggggacctgaactgtggcctctgtcatgggaacccagaggaggtcgatggcgtttgtggttgatgtgggaaggagagagagagagaagaaccagaaacgtctgcttgctggaggaagcggcatgtccgctcctccactccttttcttttccccttaggagcggtttatggttccttttgttttattcttttatttgtacactggcattggagtttgtttttttggcttttttttttttttttgagaaaaagtctcactctgtcacccaggctggagtgcagtggctcgaccttaacttactgcaacctccacctcctgggttcaaagggttctcttgcctcagcctcccaagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatctgagaagccagaggaagggttttgggtgatgctcccaggatggtgggctccgatgggatctttggagggggtgtgtctaggtcggctggtgtcaggagggtcttttgtgtgccaggcagagaactgtcccaaggagctgagagtagaggggccaggagcttcagggctgcagccagactgtggcccagggctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttcttgatttttatttttatttatttattaatttattttgagacagagtcttgctctgtgggccaggctggaatgcagtggcctgatcttggctcgctgcaacctctgcctcctgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctttttttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacacccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttctttttttttttttttttttttttgagacagcgtctcactctctcacccagaatggaatgcagtggcgctatcttggctcaaagcaacctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtccttccctggtctctggctctctgagtccctccttttttgttttgttttgttttgacacagaatcttggtttgtcacccaggctggagtgtagtggtgcaatctcagctcactgccacatccatctcctggattccatttattcttctgcctcagcctctcaggtagctgggattacaggtgcctgccataatgcccagctcaattttgtacttttagtagagacagggtttcaccatgttggccaggctggtctcaaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccagtctcaagtgattctcctgtctcagcctcctgagtagctgggattacaggtgtgcaccactaccacttgactactttttatacttttagtagagatggggtttcaccatattggccaggctggccttgaactcctgacctcaggtgattcgcccgcctcggcctcccaaagtgctggggttacaggcgtgagccaccgcacccggcccccttccttcgtcttagtcaaccctatcccacctcttcttccaccagtcccctcacctgatggtcccaacacttcatcatccaccacctcctggagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaatttttttttgataaaaaataaaagagttacatgacattcagagaccatccaaaaaacctgtgggttcccggctgggctcagtggctcatgcctgtaatcccagcactttgggaggccacagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctggtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttggtgacctggggctgggtgggcctctgagagcctttatagctgattgccttttgggagagggcaggtgggagccccaccctgtctcatgagtcaccccaaaggtgcatgggcaggcaggtgctggggaatcggctactccccagagcttggcgtggccatccctctggcccctctgggagtctggagcccattccctcacactggtactcactgcagctggggacatctgcactaggaagacaggacacggcatggaagctggcctctgcccagaagccatgacattctggtcaccagcctgatgttataaaacgagtgtcatggccgggcatggtggctcacacctgtaatcccagcactttaggaggccaaggcgggtggatcatgaggtctggagttcgagaccagccgggccaacatagtgaaatcccgtctctactaaaaataagaacattagccaggtgtggtggcacatacctgtagtcccagctcctctggaggctgaggcaggagaatcacttaaacccaggaggcagagattgcagtgagccgagacgacggcattggactccaggctgggcaacagagcatgactccgtctcaaaaacaaacaaacaaaaaaaacgagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagatcagcctgggcaacatagcgagcaccccatctccagaaaaaatttaaaaattggctgggcgcagtggctcatgcctgtgatcccagcactttgggaggccgagggggatggatcatttgaggtcaggagtttgagaccagcctggccaacatggtgaaaccccgtctctactaaaaatacaaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaacctcccccaaccaccctcagctcaagcaattctcatgcctcaaccctcagcctcatgagtaactgggactacaggcgtgcaccaccatgcccagctaatttttgtatttttagtagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctggatagccccctacccacatgcctcagcattgggaggtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtcgactaatgacccttgtccctcccctcagctgcctctcttttttctttttttttgcttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcgaactcccgacctcaggtgatccgcccgcctcagcctcccaaagtgctgggattacaggcatgagtcagcgcacgcagcccatcttaagctttttttttttttttttttttgacgaggtctctctctgtcattcaggctggagtacagtggtgccatctcagctcactgcaacctccacctcccaggttcaagcgattctccccgcctcagcctcctgaatagctaggactacaggcgtgcaccaccacgcccagctaatttttatatttttagtagagacagagttttaccacgttggccaggctggtctcaaactcctgacctcaggcgatccatgcacctcggcctcccaaagtgctgggattccaggcttgagccaccgcccctggcccatcttcactatttttaagtggacagcacagtagtattaactatatgcacatcgttgtgcaatagatctctggaactttttcaccttgcaatactgaaaccctacactcaacaaacaactcgctttccctgccccgctccagcccctgaaaacttctactctcctttctgcttctgtgaattgtactattccagatacctcccataggttgaagcaaccactatttgtctttctttgtaactggctcatttcacttagcattatgtcttcaggtttcatccatcttttagcatgtgtaagaatttccttccttgctttgtttgtttgtttgtttgtttgttgagactgagtttcactcttgtcacccaggcttagagtgcaatggtgcgaacttggctcactgcaacctctgcctcccgggttctcttgcctcagcctccagagtagctgggattacaggcgcctgccaccatgcccggctaatttttgtatttttagtagatatggggtttcaccatgttggccaggctggtctcgaactcctgaccgcaggtgatccacccacctcggcctcccaaagtgctgggattacaggtgtgagccaccacgcctggccttgtttttgtttttgtttttggagacagagttttgctctgtcgcccacgctggagtgcagtggtccgatcatacctcactgcagcctcccctcctaggctcaagcaatcttcctgcctcggctttctgagtagctcaaactacagacacacactggtcatgaaatccttgcctaagccaatgtctagaagggtttttctaatgttatcttctagaatttgtacagtttcaggtcttagatttaagtctttaatccatcttgagttgatttttgtataaggtgagagatgaggatccagtttcattctcttacatgtggctagccagttatcccagcactatttgttgaaaagggtgtcctttccccactttatgtttttgtttgctttctcgaagatcagttggctgtgtttgggtttatttctgggttctctattctgttccattggtctatgcgcctattattataccagtaccatgctgttttggtgatgatggccttaaagtatagtttgaagtcaggtaatatgatgcctccacatttgttctttttgcttagtcttgctttggctatgggactcttttttggttccatatgaattttagaattgttttctctaactctgtgaagaatgatggtggttttttgatggggattgtgttgaatttgtagattgcttttggcagtatggtcattttcacaatattgattctacccatccatgagcatgggatgtgtttccatttgtttgtgtcatctatgatttgtttcagcagtgttttgtagttttcctcatagaggtctttcacctccttggctaggtatattcctaagtacttcatttttttttgcagctattgtaaaaggggttgagttcttgatttgattctctgcttggttgctgttggtgtttagaagagctactgatttgtgtacattaattttgtatctggaaactttgctaatccttttatcagttctaggagctttctataggagtctttagggtttttgaggtaaacaatcacatcatcagcaaacagtgacagtatgacttcctctttaccaatttggataccctttatttccttctcttgtctgactgctctggctaggactttcagtactgtgttgaagaggagtggtgagagagggcatccttgtcttgtttcatttctcagagggaatgctttcaacttttccccattcagtattatgttagctgtgggtttgtcatagatggcttttattacattgaggtatgtcccttgtatgccgattttgctgagagttttaaccataaagagatgctggattttgtctaatgctttttctgcatctattgagatgatcatgtgatttttgtttttaattctgtttatgtggtgtatcacatttattgacttgcatatgttaaaccatccctccatccctggtatgaaacccacttgatcatggtggattgtctttttgatatgttgttggattcggttagctagtattttgttaagaattttagcatctgtgttcatcagggatatcagcctgtagttttcttttttagttgtatcctttcctggttttggtattagggtgatgctggcttcatagaatgaattagggagggttccttctttctctgtcttgtggaatagtgtcaataggattggtaccaattcttctttgaatgtctggtagaattctgctatgaatcagtctggtcctggacttttttggttggtaatttttaattaccacttcaatctcctgcttgttattgatctgttcagggtatctaattcttcctgatttaagctaggaagtttgtatctttccaggaatttatccatctcttctaggttttctagtttatatgcgtaaaggtgttcatagtagccttgaatgatcttttgtatttctgcccccattttgtttcttattgaggttatttgaattttctctctttttttcttggttaatcttactaatggtctatcaattttatttatcttttcaaggaaccagcgttttgtttttatcttctgaatttttttgtttgtttcaatttcatttagttcttctctgatcttggttatttcctttcttctactgggtttgggtttggtttgttcttgtttctctagttccttgacgtgtgaccttagaatgtcagtttgtgctctttcagtctttttgatgtatgcatttagggctgtgaactttcctcttaggaggaaaggtggcctttgctgtatcccagaagttttgataggctgtgtcactattgtccttcagttcaaagaattttcaaatttccatctggattttgtttttgacccagtgatcattcaggtgcacattatttaatttccatgtatttgcatggttttgaaggttccttttggagttgatttccagttttattccactgtggtctgagagagtgcttgatataatttcaactttcttaaatttattgaggctcattttgtggcctatcgtatggtctatcttggagaaagttccatgtgctgttgaatagaatgtatcctgcagttgttggatggaatgttctgtatatatctgttaagtccatttgttccaagatatagtttaaatccattttttcttcattgactttcagtcttgatgacctgtccagtgctgtcagtggagtaatgaagtccttcactattattgtgttgctgtctgtctcatttcttaggtctattagtaactgttttataaatttgggagctccagtggtaggtgcataaatgtttgggattgtgatattttcctgttggacaaggtcttttagcattatataatgtccttctttgtctttttcttcttcttcttttttttttttttttttgagacgtagtctccctctgtggcccaggctggagtgcagtggcgtgatctcagctcactgcaacctctgcttcccgggttcaagcaattctgcctcagcctcccgagtagctgggattacaggtgcccaccaccacgcctggctaatttttatatttttagtagagacagggtttcaccatattggccagggtggtcttgaactcttgacctcaggcaatctacccgcatcggcctcccaaagtgctgggattacaggcatgagccactgcacctggcccttctagtcttttttaactgctgttgctttcaagttagtttttctgatataatagctactcctgctcgcctttggtgtccacttgcatgaaatgcctttttacacccctttaccttaagtttatgtgagtccttatgtgttaggtgagtctcttcaagcagcagatagttggttggtgaattcttatccattctgcagttcttatcttttaagtggagcatttaggccatttacattcgatgttagtattgagatatgaggtagcattccatttgtcattttatttgttgcctgtgtactttggttttttgtttttgttttttaaattgtatttttgttttataggtcctgtgagatttatgtcttaaagaggttctgttttgatgtgtttccaggatttaagatttagagctccttttagcagttcttgtagtggtggcttggtagtggtgaattctctcagcaattttttgtctgaaaaagactgtatctttcatacacaatgcctagtttcgctggatacaaaattctcggctgataattgttttgtttgagaaggctgaagatgggccccaatcccttctagcttctagggtttctgctgaaaatctgctgttaatctgataggttttcctttatcagttacctggtgcttttgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgatttattcctatggttgttctggagctaaaatgcatgacacgagcctctacacgctgctctgtccgtccgagtcagagccgcaatctagtcttttaaagggctctctccacctttaaaaacccttacctataagccatctgagagttcaagtgttaagtataatctgcctgattctccttgcttggtccctacaaacaaaggctttcccttctcttgctacaagccttggtttagatatggtatagatacatagtcttattacgctgggcgagtggacctccgtttggttcaataacaaaatctgaactgaggagagttgtgattacactattgcatttcatcataaatattttccttgttgaatccaagcacacaaagtacagaatgatcctcttcctcagtacagtttttccctctgttatactagtaccatgatatcctcagctgaagaaaaggtgctagatgctctgtaccatctgatctttttgtcaggtgcttttctgatgcaaattattctctgaattcttatctctccctttcactctgagccataatcttgtctatgtcctggagctcattgcgtttttcccagaacacagttgagtattcaaggacctcccgtaagctttttccctcttcttctcttgctatattttcaatatcacaaccccattttaattagctttgataagctggttaaaatctctgagttcaattggtaaatccctgtgttaactctatctcttcatcaataaggggttcagcttatttaaactgttctttttctgtgcctatgctgcatttggtaggtcgtgattttgaggtaccttgtacccagttgcttttctgtaatacagagtttctttttctagtaattaaaataaatgttgggccagatgcggtggctcacgtctgtaatcccagcactttgggaggtcagggtgggcagatcacctgatgtcaggagtttgagaccagcctggccaacatggtgaaaccccatctctgccaaaaatacaaaaattagctgggcgtggtggcaggtgcctgtaatcccagctacttgggaggctgaggcaggagaattgcttgaacctgggaggcagaggttgcagtgagccgagattgtgccattgcactccagcctgggcaacaatagtgaaactctgtctcaaaataaaataaataaataaaatttaaaaataaaataaaataaatgtggaggaaagaactggaaatcctgaaatttttgttttttcaactttttcttcttttttaatacaatttagcaccaataataaagcatcaataatagtaaggcttttctacatatctgagatctcttccttaatatattatttatcacctccccaataatatatttgttacttatggagtgaaaagccttcaacctatttccttttgcagcaatagaggccaagcacagtgttactgctctcaagaaaaagaacacacaagcaatttcagcttagaaacaatacttaaaagggaggacagtttataaaattccatctaggttgcttgaaaatagctttctctatcttgccaataagtaatttactgaaacttctttgtactttgacctgaatctgtggagactctattctattaataatttgtaaagtttataaattccttcctacaaaagtttttcaacatatattggaatctggggtttcaaaagccttcctccttatttacttctctttgccaattaaaatcacacactgtttctttgaccaagaaatgggaaaatgactactctatccctatacactgtggcttccactaagtgggaggaaaggcttcctaggacatgtgtttaactctgtaatttgctctcgaaactgctgccccaatgtacccaaatatatgaatctctatgttctttttatttaacccaaaatatacctgatctattctgcactaaatatcaacaacaaagacagggctccaggaagtaacttgcagaattgtcttgtttaaaaataggattaacaagcttcttggtaaggtgagctttttcctgcctccctccccactcccacttctaaccctgtaacattctttgtttatgtacatttggttcagagggatacttctgctgctgccttattattaataatagcagattaaacttcagtgcctcagggttggaggattctcttttatactacaaacactttgggccgcccactataggaagtgccatgctaagtatattagggaggttcaaaagatgtgaaaagacacaccagtgctctcacaaagcttaccaactcactaggaaaataaatcatacactatgaaacaacatgaaagtaattactctgaaattttattatttttaacacatacatttcacaaacaatacctttaacaccacatacaattccataacaaaatattttaattttgtcaacgttcttttttgtttgttttttgagatggagtctcgctgtgtcactcaggctggagtgcagtggtgcgatctcggcttactgcaacctccgcctcccaagttcaaatgattctcctccctcagcctcctgcctcagcctcccgagtagctgggactacagccgcgtgccaccacacccagctaatttttttgtatttttagtagaaatggggtttcaccatgttagccagtatggtctctatctcctgacctcatgatctgcccgcctcagcctcccaaagtgctgggattacaggcgtgagccaccgtgcccagcctcaacgttctttaactttttacaatcttctctcaacaaaagtgtaacccaagataccttgacaagaaatcttccagataaatatttttgagctagtttcaatgatgcctatccactaaattttctctcaaatacttgcaataataataaagtcaacagtactctaggcaagagtatactgaggaagtacacaattaatcagttcttcccaaaaaataatcgtaatagtttcttcctcaaatcttttcttctgcaatgtctaatctcatccattgtatttttcatctcagacactgtagttttcatttatagaaattcaattttggtcttctttttatatcttccatgtcttaagtgtttgaacaagtgcaatacagttataataacttttattttccttctctgctaattcggtcatctatatcagttttgggttagtttcaattattctcttcattataactcatgggtttttttgccctttgcatgtctgataatctttgattcaatgctagacagtgaaaccacctctgcaaaaatcataactgagaaaattattacagtgaaagagatctgacataaccagctccatcttgcttctaatcaccaagctgtccttgttcatttctaggtacaggctgaactaacttttgggaggaatttagtttatagtttagctttgaaaccaagacaataacagccatttcccaaacaaactccattcctgcctggggactagactcccttttcaggacaacaaattagccaaaagattagaaattgtggtttaggagtcatgtagctggaagctgcccaaattgctaaacctccccaaattgctcctgcggataacatcactattgtaaaacctaagatcagtgcttgaaatattttgcagaccctaaactcagtcgatcggctggcataacccagattgataagctggctcatctggtcttgtggcccccagtcaggaactgactcaacacaaaaggacagctctgactccctatgatttcatctcagactgactaatcaaaactcctaactcactggccccctatcaaattatccttaaaaactcagatcgtcagattctcagggagactgatttaagtaataataaaactggtctcctgcatagccagctctgcgtgaatttctctttctctactgcaattcccgtcttgataagttggctctttctaggcagtgggcaaggtgaacctgttggatgggttacaacattgtgaattttactttgttgggtgctggatatttttgtattcctgtaaatcttgagctttgctcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactccatcttgatctccctaactcagggagtgttctagactccagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttcttttcaccctcttttttaacttattttgaaataatttcatactgacaagttacaaaaacagtagagagaggttctgtatacccatcactcagttcccctaatggtgacagcttctataagtatactgcactatcaaaaccaggaaattagctggcaaattaactggactatagaccttactcagatttcaccagtttttacatgcattcatttttcgggtatgtctttgtatatactcatgacattttatctatcacatatatagcttcatatataaccatcattttaatcaagatatggaactgttctgtcactacaaaggaagtcccttgtcatgtccctttaaagtcatactctccttctccttccctaacctatggcaaccacttgtctattctctacatctttaattttgtcgtttcaacaatgttatataaatggaatcatagagtatggaccattttgagattggcttttttcactcagaataatgcccttaaattcccttcaagttgtttacatcaacagattgttccctttgtcggtgaattaccttatgtggacataccatgagtcatatgaacattcagtaatggaaggatatttaagtcatttccagttttttggctattacaaataaagctgtgaacatttgtgtacaggtttttgtgtgaacataagttacatttccccaggataaatgcccaggaatataaatgctaggtgattaatggtagtttctttttttttctatttttttaagaaactgccagactgagttatagagtagctgtatcattttacattcccaccagtaatgtagaagagatccagtttctctgcacacttgccagcatttgaataatcagtatttttaatttttgccattctagtaagtatgtagtattttattctggttttaatgtgcatttccctaatggctagtgatgttaatatctttttgtgtatttatttgccatcatatatcttctatggttgcactgtttcttaaaagttacaagattaaacttctgtgtgcacgaatcatgttttcttcactactggggatagttcacttaggataaggatttggctatggtttaatatttcttgaatgaccaaaataaatacaaagacaataataaaacaaaaccccacaggcatcacaaacagaactcataatgctctgagattggggcctgcactttgaactctagtctagggatcagcaaactatagctcacgggccaaatctggccaggggcctgtttttgtatgccctgaaagctaagaagggcttttactttttttttttttgagacggagtctctgtcacccaggctggagtccagtggcatgatctcggctcactgcaatctctgcctcctgggttcaagcaattctccctgccttagcctcccgagtagctgggatttcaggcacccgccaccacacccagctaatttttgtatgtttagtagagacagggtttcgccatgttggccaggctggtctctaactcctgaccttaggtgatccatgcacctcggcctcccaaagtgctgggattacaggcgtgagcgaccgtgcccggccgggcttttacatttttaaagggttatttaaaaacaaaaaaatatatgcaacagagtccatatgtaatctgctaagtctaacatatttactatatggtgtttacagataaagtttgcagatgaatggaaagaaaacctgatcttcttttttggggcaaacattaacaacattgacatctgattacccatgatactctcaagatcttattctttaacaaaaaggtggggaaataaaaacaccataaaagcggccgggtgcagtggctcacgcctgtaatcccagcactttgggaggccgaggtgggcggatcatgaggtcaggaggtgagaccagcctggccaatatggtgaaaccctgtctctactaaaaatacaaaaattagccgggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatagaaataatgactgaagttgtgagaatagttttaaaacaatctaaattttagaaaggcatatgattccatgaataaatgaataaaaatatgacaaaatagctttagcttataattcaaacatgcttacatatgccaataattttggttatgctatgattcagagcacagttaaacaaacttgtattattgttttagattattgggaccaaaaataggtaactctcttggctccttatcaaattcaagcattagatcacaagttgattctcactatatttgatacccagtcacacactgcataattatgtttcagtcaacgatgaactacagaaatgatggttgtcccataagattataatagaggtaaaaaactcctatcacctagtgacttcgtagccatcctaatggttgtttaaatgcaatgcactacctgcatttgtggtgatgctggtgtaaacaaacccactccactgtcataaaaaagtatagcacatatgttatgtgtagttcataatacttgataatgagaataaatgaccgtgttactgatttatgtatttactatactttttatcgttagagtgtatatcttctgcttattaaaaaaaaaaaaaaaagttacgatacaacagcctcaggcaagtccttcaggaagtattccagaagaaggcattatcatcacaggagatgacagctccacgtgtgttattgcccctgaaggcctttcagtgggacaagatgtggaggtgaaagtgatactgacattctttacccagtaaaagcctagactaatgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaagttttttattttattttatttttttctgagagggagtctcgctcttgctcagactggagggcagtggcgcgatattggctcattgcaccctctgcctcctggtttcaagggattctttttcctcagcctcctgagtagctgagattacaggcgcccgccaccacgcccggctaatttttgtattttagtagaaatgggggtttcaccatgttggtcacgctggtctggaactcctgacctcaaacgatctgcccacctcggcctcccaaagtgctgggattacaggcgtaagccaccgtgcccagcctcaaaaaattttttaaaatgtaagtttataaagtaaaaatgttctttgggaagttgaggtgggaggatcacttaaggccaggagctgaagacaagcctgggaaacatagcaaggccttgtctctgctaaaaactttttaaaaattagctgggcatggtagtgcacacctgcaacctagctactagggaggctgaggcagaaggatcacttgagcccagagtttgagtttatagtgagctataattgcactccagtctatgcaacagagaaagcagctatctctagaataaataaagtaaaaaagttacagtaaactaaggctaatttattattgaagaaacttaaaaataaatttagtgtagcctaactgtacagtgtttataaagtctatagtagtaatgtcctaggccttcacatgcactcaccactcatcatactgactcactcagagcaacttccagtcctacaagctccacttatggtaagtgccctatacaggcgtaccatgttttatcttttataccagatttttactgtaccttttctatatatagatatacaaataccattgtgttacaattccctacagttttcagtacagtagcctgctgtacagggtgtagcctaggaataataggctactacacagcctcagtgtatagtaggctgtaccatctaggtttgtataagttcactctataatgttcacatgacaacaaaattgcctaataacacatttctcagaatgtatctctgtcattaagtgatgcatgactgtacttagattttcatcaaatttttgccacttaactatgggtttgcccattaagtggcatgcagttatatctgggagtgtataggtattatttttattcctgttatgttttttgttaatattctatgaattttaacagacaactttcttaattttcacgacatataaaatgaatacctaaaactgaaatttgatcttatgaagaccaccctcccctactccccaattcttcctttttctagttggcatctcatggatttagcttgtagcattcatccctatacacggtctaattgcaatgtcctccttgatgccattctggtaaaatttaaaggaaaacttcaccagcattaatttttttattcattaaaacaacaaaccttggccaggtgcagtggctcatgcctataatcccagcactttgggaggctgaggtgggctgatcacctgaggtcaggaatttgagagtagcctggccaacatggtaaaaccctgtctctattaaaaatacaaaaaaaattagccaggcatggtggtgcatgcctgtagtcccagctactcaggagggtgaggcaacagaatcgtttgaacccgggaggcggaggttgcagtgagccaaggtcacgccactgcactccagtatgggcaatagagtaagactctgtctcaaacaacaaaaaaaccaaccaatgacaaaccttaaaaaaatagtatcagccaccactgtagccagatataatgaaaaatgtacaaaaacgattcacatttgtgctactgagaatttgttgttctgaaagagcaagtttaaaatgtacataccaaacaaaattccgatttactccagtcacacgaagttagttttaaattttgcactataatatatgtattcagtttaagttcgagaattagaaaacagctcttctagaaaatttaaaaatcaattttacccaatgacaggactaatgagtcttcctaaatgatttaatgaggtctttttaaacaaaatgtctgcatcatattaatgataagcaactagaagaaaaaaagatgtcaaacatgaggacataataatggaaaaatataaaaaagctaaaatttccgttaagtgtaccacatttctacttatgtatggagaatggctattcatctgacagagcaaaatgcagcctccttaccagtcactgttacaacatcatctttacgagcttcagccatttcctgaacatggacttctgagttcacatcaacctctttccctgataactgtaaatgagcttgaagtgaagatgggaccttgacaataatagaacctgtaataaatataatggagagcttagtaatataaagaaatcaaaagtaccagagtctattataaatttgactgacagggtagcattgctcctgagacactgtttttactcctcagcatacagtatttatttaaaccttttccttattcccaggtgcccaaagtttccttactctcggcattcacagtaacttctgtcaagaatatgggttattagcacattattaactactagatctgcttttgccaatagtcctacacagctcatccaacaccagaaagtgagtaatttactacacatgtagcttatagataggatttgccattgagcatttaatatgagccagacccctaattacattatgttttaatccccatattaactttatgaggtattattatcgccccgattttatagataagaacttgctcaagttcccactagtgctcgtgctggaacctagactcagctcaataattacaaagcccatgcttttttttttattattatactttaagttttagggtacatgtgcacaacgtgcaggttagttacatatgtatacatgtgccatgttggtgtgctgcacccattaacttgtcatttaacattaggtatatctcctaatgctatcactccccactgccctgaccccacaacaggccccggtgtgtgatgttccccttcctgtgtccatgtgttctcattgttcaattcccacctatgagtgagaacatgcggtgtttggttttttgtccttgcagtagtttgctgagaatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgccacgataaacatacgtgtgcatgtctttatagcagcatgatttataatcctttgggtatatacccagtaatgggatggctgggtcaaatggtatttctagttcaagatccctgaggaatcgctacactgacttccacaatgtttgaattagcttacagtccacccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatatcctttgtccactttttgatggggctgtttgtttttttcttgtaaatttgtttgagttcattgtagattctggatatgagccctttgtcagatgagtagattgcaaaaaatttctcccattcagtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggtcttcttctagggattttatggttttaggtctaacatttaagtctttaatccatcttgaattaatttttgtataaggtgtaaggaagggatccagtttcaggtttctacatatggctagccagttttcccagcaccatttattaaatagggaatcctttccccattgcttgtttttgtcaggtttgtcaaagatcagatggttgtagatatgcggcgttatttctgagggctctgttctgttccattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaaaaggtccttcacgtcccttgtaagttgaattcctaggtattttattctctttgaagcaattgtaaatgggagttcactcatgatttagctctctgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctctattcctaattgaataccctttatttccttctgctgcctgattgccctggccagaactttcaatactatgttgaagaggtgtggtgagagagggcatccctgtcttgtgccagttttcaaggggaatgcttccagtttttgcctgttcagtatgatattggctgtgggtttgtcgtagatagctcttattattttgagatacgtcccatcaatacctaatttattgagagtttttagcatgaagcgttgttgaattttgtcaaggccttttctgcatctattgagataatcatatggtttttgtcgttggttctgtttatatgctggattatgtttattgatttgcatatgttgaaccagccttgcatcccagggatgaagcccacttgatcatggtggataagcttcttgatgtgctgctggatttggtttgccagtattttattgaggatttttgcatcgatgttcatcaggaatattggtctaaaattctctttttttgtgtgtctctgccaggctttggtatcaggatgatgctggcctcataaaatgagttaggaaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtccagaaatttatccatttcttctagattttcgagtttatttccgtagaggtgtttatagtattctctgatggtagtttgtatttctgtgggatcggtgatgatatcccctttgtcattttttattgcgtctatttgattcttctctcttttcttcttaattaatcttgctagtggtctatcaattttgttgatcttttcaaaaaaccagctcctgcattcattgattttttgaaggtttttttgtgtctctatttccttcagttctgctctgatcttagttatttcttgccttctgctagcttttgaatgtgtttgctcttgcttctctagttcttttaattgtgatgttagggtgtcaattttagatctttcctgcttcctcttgtgggcatttagtgctataaatttccctctacacactgctttgacataccagagcataccagagattctggtatctttgacataccagagattctggtatattgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttcctgaggagtgctttacttccaactaagtggtcaattttggaataagtgcggtgtggtgctgagaagaatgtatattctgttgatttggggtggagagttctgtagatgtctcttaggtctgcttggtgcagagctgagttcaattcctggatatccttgttaactttctgtctcgttgatctgtctaatgctgacagtagggtgttaaagtctcccattattattgtgtgggagtctaagtctctttgtaggtctctaaggacttgctttatgaatctgggtgctcctgtattgggtgcatatatatttacgatagttatctcttcttgttgaattgatccctttaccatattatgtaatggccttctttgtctcttttgatctttgctggtttaaagtctgttttatcagagactaggattgcaacccctgcctttttttgttttctatttgcttggtagatcttcctccatcctttattttgagcctatgtgtgtctctgcacatgagatgggtttcctgaatacagcacactgatgggtcttgagtctttatccaatttgccagtctgtctcttttaattggagcatttagcccatttacatttaaggttaatattgttatgtgtgaatttgatcctgtcattatgatgttagctggttattttgctcattagttgatgcagtttcttcctagcctcgatggtcttcacaatttggcatgtttttgcagtggctggtaccggttgttcctttccatgtttagtgcttccttcaggagctgttttaggggcggcctgttggtgacaaaatctctcagcatttgcttgtctgtaaagtattttatttctccttctcttatgaagcttagtttggctggatatgaaattctgggttgaaaattcttttctttaagaatgttgaatattggcccccactcacttctggcttgtagagtttctgccaatagatcagctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagactggggaagttctcctggataatatcctgcagagtgttttccaacttggttccattctccccatcactttcgggtacaccaatcagatgtagatttggtcttttcacatagtcccatatttcttagaggttttgttcatttctttttattcttttttctctaaacttcttgcttcatttcattcatttcatcttccatcactgataccctttcttccagttgatcgaatcagctactgaggcttgtgcattcgtcacatagttctcatgccttggttttcagctccatcaggtcctttaaggacttctctgcattgattattctagttagccattcatctaattttttttcaaggtttttaacttctttgccatgggttcaaacttcctcctttagctcagagtagtttgattgtctgaagccttcttctctcaactcgtcaaagtcattctccatccagctttgttccgttactggtgaggagccgcgttcctctagaggaggagaggcgctctgattttgagagtttccagtttttctgctctgtttttttccccatctttgtggttttatctacctttggtctttgatgatggtgacgtacagatggggtttttgtgtggatgtcctttctgtttgttagtcttccttctaacagtcaggaccctcagctgcaggtctgttggagtttgctggaggtctactccagaccgtttgcctgggtatcagcagcggaggctgcagaacagcggatattggtgaacagcagatgttgctgcctgatcattagtctggaagttttgtctcagaggagtacctggctgtgtgaggtgtccatctgcctgtactgggggatacctcccagttaggctactcgggggtcagggacccacttgaggcagtctgtccattctcagatgtccagctgtgtgctgggagaaccattactctcttcaagcctgtcagacagggacatttaagtttgcagagctttctgctgccttttgtttggctgtgccctgcccccagatgtggagtctacagaggcaagcaggcctccttgagctgcggtgggctccacccagttcgagcttcatggccactttgtttacctactcaagcctcggcaatggttggcgcccctcccctagcctcgctgctgccttgcagtttgatctcagactgctgtgctagcaatgagcgaggctccgtgggcataggaccctcagagccaggcgtgggatataatctcctggtgtgccgtttgctaagaccattggaaatgagcagtattagggtgggagtgacccgattttccaagtgctgtctgtcaccccctttctttgactaggaaagggtactccctgaccccttgcgcttcccgggtgaggcgatgcctcgcccttcttcggctcacgctcggtgtgctgcgcccactgtcctgcacccactttctgacactccccagtgagatgaacccggtacctcagtgggaaatgcagaaatcacccgtcttctgcgtcgctcacactggcagctgtagactggagctgttcgtattcggccatcttggctccaccccaaagcccatgcttttaaccaccatggtatttcacacactcctacctcatcgtagtacaggacttgtgacctcattattataacacaactagaacactgagctcttgtgctttcagatgtgccttgtgtgtaacaaaaaataacaatagaaaaggattatttgaattccaactcactaatgtttcttttgagtagattacaggcttttggatacctaaggtaagacactcaacctgtatttccatacaacctggctgtaattcaagcttctaaaggagtaaatcaggaaaagtactctgttaggtatggaatcatttttcgaattatgtgggttgcagcgtaaattcaccaacacactcctatttcagaagtttttcttcctgtttttcattaaataaagtaggtaaaaggcccctgccataaagcattaaccccacctctgtggacaaagatagttaggatggggtttagaatgcatttacttatgggtcgtggttttccttccaatctggctaacatcagcttaagcttccttaagtaatttcttggtcttcctaactggagctagaagtttgagataaacatgatgaactgttctattctaaaaaaaattagggaacaatgcatattactagaactagtttattttattaagaaataaattgcagccaggcacagtggcttgtggctgtaatcccagcactttgggaggccaaggtaggtggattgcttgagctcaagggttcgagaccagcctggacaacatggtgaaaccctgtttctacctcccccagctcaaaaaaaaaaaaaaaaaaaaaaagctgggtgtggtggtgcacaactgtagtctcatctacctggaaggctgacctcccaagcttaggcgatcctgatgaggctgcactgagccatgaccttgctgctgcactccagcctgggtgacagagtgataccctgtctcaaaaacaaaaacaaaaaaccaaatttctttccagggttcaaatgtaaactacagacaggagattcccataacaacatatgagggctttaggaaaaaacaaaacaaaaacaaccctggaagatttcaggataaatagaggacacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctggaacgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagttttacagttttctgtttgttttattttgcctactgtgcaaaacattaaattatttgtatgtaacagctgcttattcaaaactttgttcttactctgttactagttatattaacaatatatccttcttctctttggatctttgtgataatggagtacagttatatgacttacatgccatttataattttccctgaagcgtattacctgaagctcttagatttagtgaggacataagtttatcctattttaaagggagaaaatatgatattgagaagtcacaccggtgcatcagcaataactgaggtttcagacctctgtgttttgcagttttgacactgacaaattctagagatggattaaaaaaaactattacatcaatatggtaaagcaactactaatagcaggaacaatcagtctctgtgaggaaatattttccttgttaaacatctggccaacatgcaagagctgctagactatttaaaaaatttttttatacagagctacagttcttaactttctgcagccaagccacttcagcccctatggccaacctacttcacccaagccacttgtcaacacatatgtgtacatccatgtgtgcagaagaacagacaaattcatatttatctttcagatgaaaagtataccattttaaatgaaagagttggactcagaataagttgtgtcagaagttaaatgatagagacatatcataagtcttgatacttcaagagactaagtaatcactttagaggacctttctgtgtgatacctttatttaaggatcacactttgaaaactgttactctacactgattgcctgagaagttccttttacaggctggcagagaagcttccaaaagagtgtatggcagtgtttttccttcaaagattattctatttcagaatagaataaactgaaaaatccacagagtaacatttaaaaattccataataacagtcaaaatattacatttttgtttgtactacaaagggaaagatagtctgcatggccatctatcccaaaagttgtaaagatcactggtctagaaagctagcagaccagtgcctttaaattaggttctatcagaagatattttcttgaaatcactatgtcagtatagataatttgaccatctgtttcctgagtgttacataaaccttccttacatcatatgtcaaaataaaacattccagttcactaacctttatgggatttcaattccactttccccagttggctgacataaacatctatggcaccctgattagttgaggcttttagacatccagaagacgaatctaggaagaagaaaaaa

SEQ ID NO: 1226 - DNA, 300496 bp, Homo sapiens
tcactgaattgaaaatttttatagtttttattaaagccaatgagaaagagaaacagatgaatgaaaaactatgaattcaagacctcaactcatatcttagtgctccataaatgctttagtttatgagtcaaatagtgatattttaatttcaaggtgggatcttcaaaagctttataaatattattagctgtatagctgtaactgttatcattttagcacctaactcatacaattaacctttttttctttcaaatcatcagcatattaaaatactacagtgattggttgaattctattctcaatctgttttgagtaaatgtgctaatcttaaaagaaaaaaatgatactttgtatttcttatctttcagtaattaaaacaaataatctaatcgttacatttttgctacataatttgtttttttttttttaatttgaaaacttacccctaagggggaaaaatattcttgcttcaacctttttactaagacctagccttcaagagagaattataggaaataggccattaggtgttttgaagattgcttaatgcagcagttcccagggtcttatgctgagatagtaagtacccaggggtagtattatggggtgggagaaagcatagttcatggtaaaaataggtttggaatagccttaagttaaaaagagtactgtaggcttctcagagcctttaatgggcttgtgttcatgtcaaattctttagaaaaaaactggcttaaaagtactgatcaaaagaccatagaagataaaagaaaaaaaaacatggcagaaaccaacttgagtgatgcagtcagataaaatgaaaagcagaaatgaaatgacaaccttagcctgggtgtgtagctagagagacagaaggtgaaggtcaatttcactgcattacaaataaagcctatgtctgactttcagggaaattgctgttggctttatcaaatgtctcttggagtccacttccccctctaagtagagggacctagtctctttcctgccactgcatctccagtgcctagaacagtgtctgtcacagagaaaatgctaaaacattatttatcaaatagagtgaataataaataaatgacagttaaagcataataactaaaattatataatttggagacttcaatggatggcccacttgtacaaatgaagacttccaggtgtttcctaatcctgtctctatcctgagggattatacctaaggggttttccacaggaaaagtttgcacagccttggcaacctgccactgcacgtgaaggcacagtcaagagtggttatttgtgagaaaacaataagatttgaagagagtttgactgtcctttgcacagtatatttttgctcattaaataatgttaattttaagcttaaccctaaagcttggatttttatattgatattgcctcacatttataaaatagttttcagttctcttccaaattgattagctctatcagtcatgaataaaatgacaaaatagcccattgcataaagagggaaaaaaagcaaatcatgtgaatgattttcccaaggtcccagaattattttacagaagacccaagattagaaccaaggtcttccaacttctctattcatcgtaacacacagaagagtgaacatgaattccatctggtttgagaaatcccctgacttgcagtggaatggaaactttcttttaaaaataacctctatttaaaaagaagtctacatgactaattctcttaaaataataaaacaataataagaccacataaaagtcatctaaaaagcctggtgaagagaagatcaaagatgcttatgtaacgacaagatagaagccaagcttcagaattcaaagcttttgtgagctctaatcattttgcttgcattcataaaatcttaaacattttccctctattttttgatgtataatattcaatcaattgtaatggaatgtaagtggagagggctggtaatggctcctaagcatgaaagtgaaaccatggcccatgtgcagcgctgccgcccagaggggagaggcagccttttccttcgtatccggatccttttagaaaagagatatggcctgcgactgactggtgccacttttattccttttcttataagttaattgaaatagaagggctttgttttttccccttttccactctaaagtcaaaggcactgactaggttcactgctgggctatagatgtgtgtgttctttttcaatagaattgtacatttccttataaatatatgtaatatataatatatatgtaatagatattaaagggatgggggaccattctgtgacatcctgggcaatagcattttcccagtttattgagatttttgaattgcaagtgggattaaatcttcatgactgactcacttcttatgctactgcacaaaagctgagggagttgacatttaaactcatgtgattaaacaattcataagtcttttaaaactgtacattttgacatgaaaagaatgcaaaaatattcacaagctacttagctagtgaattaggagcttttaacagaaaaagaaaataaaagaaggctttttattttttcaaagaagtggttgtatacaaccactttctcaagttttctggtatgtatttatgagattaaatgtataaaagaatgtggtgtcttcaagcagttaaataacaagctcctgttgagaaaacatcttgtagcaacaaaagagcttttaattccaaatttaataaatggagggaggggagcttttgatggtaagaaatggaaaagacagaagaaagaacatttgagggatggtggagggtaaacaaaacagcactcagcctagaaggtattcattttctgtccttaatgtaaggaaaaccataaaaacatctgcagttgaagattcagaaaattttcacagagaacattgggtttttataaacaacaaaaagagtcacatcaaaatttccttccttgaaacatttatgtaacaggaattaggaataggaatcaaaatggttttgttgtgaatagttaaggcagagagtatctgcattttgtattactgagaagatcctgtagagagtatatcccttttgtcacaaaggagagattggttcatcatgtgccatcatgggttccaggactaggacatttaaataaaggcacatgcagaacaaggttagtgaatgaagaggacaagagcagacatccagtcagttaccacgatgatagaggatggtgattgccaccaaaagtcataacgaatgttttgcatgtcacttataatttcatatatatgtgtggtattccccagccaatattcagcttatcttggttaatctctttttgtgtcttttttaaagctcctaattgaaaatgtttttgtcaagatttgttaaagaaaaaagtattctatgaaacattatgtttattaaagaaaaatacatccagccaacattgttattttcatcctagcctgagtgaaaaatcacataagcatatcacttagaggatgatttttaaacagagtctattattatttgaatgacttcactccaatccaaagcacactgggaactgtaaaatgttacagacgctatttcatcataaaggcagtgtgttatgggggaaatcattcttagctgtatgggagaagacatgactcccgacccagccactcattgaccaactatgtcgcaatgggaaaatcacttataatctgatacttttcttatctgtaaaaaaagagaagagaattattctatatgctgggactaaagagaataatgagtgaaataaggcatatgactattattatttttgttattatcagcataaataaaactcatagcactttgtagtctacaagttactttcaattgctttattctatttaattctcacagcaactctctgaaacaggttttatggtctccatttttcagatgaggaaatggagtcaaagaggtcagcacctgtgtgatatgatcaggaaaataaagtgccaggactaaaattctgattttcagatgccctacatcatgacccactaccccaaatcatttcattataaatattctagtttcatactaccttacagagtcaacaagggatgttaggcattccacatctacctgaataattccagcaattggggtaccctttcctcctgaggaaacccatctgtatgtcactattctcattttttaaaagttctcctttctcttgatccaaaatccaactctttgtaacttctgcttatatttttctatttctgtcttctaagaatgtacaaaataaatgaaattccttttcaactgaatgacttttgagttactccaaacttttatctctcttctggaaactaatcctttctaaaatacttagaggatacacttgctagtctcctcatcacaatgattttttttttaactctggaaatatattagttgtcaaaggcatctttttgttgtgtccaatatagcgcttataatattgtgtttgattttatgttaatttatctatctctcctattaaattatgtgcttcttcaaggtggagaggggatcataatatttattttttatttgtttccctgagacctaatataaaccttggaacataaaaaacctttaatattgcatgttaaattagtacactaaaatattaattgaatttaaccctaagcagcatccccaaaattgatacttaattatagaaattcaatttatagagtgaaacaggccacagttcaacttgatcatttctttagtcaaggctatgatgtaataacgggctcttaatttgcagaaaggaggtagacactgtcctccaaagctaatggtagaatctaaaaagacttcacaagagaagtgacaggccattttatctggaattggaagaaaaattatgcttttatgtaaagcaaaagcagtaagagtttaattctacaaaatacattgggactatattatgtaaagttttggaaattggaaaaaaatggctaggactttacctgctagacaatagtgacaagcaaaaattgctaagcagacaagttatgtgatattaatgatttcaaatatgtccctgaagctgacaaacccattctaaatgtttttcagctttcccaaatcgagatgacgagcacctgaataagattattgacactctgaaaggggagcagaggtgaaagtcatggacatgacaaagagggaggggaagtggtgcttttggggtgctacatgaaggttaaggacatgcaccaaataatggaaggactttactccgttaatttattcatttaacaaatatttattaaatctttactacagatatggttcctgttcttatgcagcttacagtgtagtgcaggaaagggcacgatttaaaaggaataaaagtaaggtgggatcagttgtaaattgggccagcttcacaggcactcggccagtacagtcacacaaggccgtatgctcagaagagccaagctcttggagtttaatgttctgcagtcattgtcttgaaatgtttaatacttttatctttaaatctgtgttttataattaccatccaatgagacaatggagcttgtgttggaggtttgaagcttcagctttcatgcagttctggctttcccttcctctcccacctctccaggaaggttcttagctgcctgctctctgcatcctggtgtcccaggccctgtctggccttccccttcctgccccaaccactgccaccctccaagtaagtggcaataggtctcagtagcagaaggagtcctgtcctctgccattgcctccagagggtgcctgggcatgagcacaaggacagttgagtggatgcacacctaatggcatcttgaaggcatgggggtgctggtgggagcagcgggaatccgtgcctcagagggcagtgccctggcaaattcggtaggtgacttggtgggtgcctcacatctaccctctagcaagcatgtcccagaagggggattgtaatttcctgggggtttcttatccactgtgtatggagacggtggcccatggaagggaagattgatttcccctgtgacagtcagggcttgaattcttgttttgcacaaggatctgcagacaatatagcaggccctgattataaaacagctgaagttagggacagtctataagtacctaacccggtagggagtgtggaggcctcatagtttccccagacatttaatctgagactatatctaagaactggtaagagttatccaggcagaaaggaggatgaagaaagttccagaaagaaataacatatgaaggcccagggttgaatcggagcccagaaagtgttccaggaactaagagaagttgagtgtgatgggaatggaaatggtgagcaacatggaggcaaatggcaagtcacggttagagcggaggtcagcagctctgccatacaacaaaagggcttgggaagatagctggaggagtagcaaaattaaagagtgttgtctcccagtgtttgctgtgtttaggatccatcttacctaccctgtgcctgtagagtccatttttgacatttaaataatggttgttacagtattttctgtaatatgtcatgtggctggaatgagcccatcatcctcccattgtcgaacttagatcctggatccttgtcacctatgaatgtgatgaaaagtgccctttttcctcagatttctgcaagctgcatattttgaagaaaagtgctcatcatgaaatcaaacaatcacaagtttatcttgtgcttcatcgccagcctctactgagagaaatactgtagttatttcacccaaactctccctgggagattgtgttatgcaaaagctaagtgaatggacctcaagagtgtaccaaaaaaatgtctccaagttgcaacaaagcatatttttcagaactgacataaagtcgatttttttccttagtaaggattgtttttatcacattgacatttagtttattagagctaactttataagaccagttcctaaagagctttttacctaaatctgttgccattttctatagataagatgagaaaatgctgaaaaagtatggtttttccctcaaagattattcaaaataaaatcacatcatcagttctttaccaccaggaagcggcataattacctcagactttcaaggaaacaggtatgcccagcaattggtttaatttaggcttagaattgttttcttcatccaaattgctagttcatcttctctatccttgatatactttttaatggaaaagaatctatttctattattgacttgtaagagtataattgaaaaataattagcaaggcttttacaaatgaatgcaggaaagagaaaagatatatatatatatatatatatatatatatatatatatatatatatatatatatatgtatgtatgtatatacttcaaaagtagtttccaataaatgccactagtctggtatccaataaatgccacaaaaaattagaaaagagaactaacttttgtggcacttttaacatgcaccagacaagttagatatgattattccaacttaatattcacagcatcccaatgttacccaaaagaaaatgagacagaaagggttcaataaacttgccccatctcacatgagatttactgatagagccaagccttaaattcaagtgtatcttatcgtaaattccttgtctcttctgtctcatgttaaaacattgaaaactaaactggagtagaattctgtgattgaagtataatttgcaataagaaagtcatgttatttatttagtcaataagaaagactttaaatcaatgtatttttgccttagtgtaataattattggatgcatagtgcttaactagctttatcagtatctataatatgatttgtttaaatcatgtctttaacttttgttttaagttcagggctacacgtgcaggtttgttacataggtaaattgcatgtcatgggagtttggtgtacagattattttgtcacccaggtaataagcatagtgtctgataggtagtttttgttgttgttgttgttttgttttgttttattttgttattgagatggaatctcactttgttgccaggctggaatgtagtggtgcgatctcggctcactgcaacctccgcctcccgggttcaagcgattctcctgcctcagcctcccgagcagctggtagtacaggtgtgtgctaccatgaccagctaatttttgtatttttagtagagatggggtttcaccatgttggcaaggatgatctcgatctcttgacctcgtgatctgcctgccttggcctcccaaagtgctgggattacaggcgtgagccaccgcgcccagatgatacgtagttttttttatctttaattttctcccaccttccaccctcagtaggccccagtagctgttgttccctcctttgggttcacatgtactcgtgtttagctcccacttataagtgaaaacatgtagtatttggttttctgctcctgtgttactttgcttaggataatgacctccagctccatgcatgttgctgcaaatgacatgatctcattttttatggctacatagcattctatagtggatatgtaccacattttctttatcaagtctaccaccgatggtcaattaggtagattttatgtcattgctatttgaatagtgctgcaatgaacatatgcatgcatgtgtctttagggtagaaagatttatattcttttgtgtatatatccaataatggcatgctgggtcaaatggtaattctgttttgaattccttaagaaatcaccaactgttttccacaatggctgaactaatttacattctcatcagtagtgcataaacattcccttttcttcactacctcaccagcatctgttatttgttaactttttaataatagccattctgactggtgtgagatggtatctcattgtggctttgatttgcatttctctaatgattattgatgctgaacattttttcatatgcttgttggctgcagatacgtcttttaaaaagaggctgttcgtgtccttagccaactttttcatggggttatttattgcttgttaatttgtttaagttccttatagattctggatattagatctttgtcagatgcacagtttgcaaaatatcttcttctgttctgtaggttatctgtttactctcttgatagtttcttttgctgtgcagaaactggttagttaaattaggtcctatgtgtcaacttttgtttttgttaccattgcttttggtgtcttcatcatgaagtctttgtcagggcctatgtccagaatggcacttcctaggttatcttccagagtttttatagttttaagttttacatttaagtctttaatctatgatgagttgacttttgtatatggtataaggaagggattccgttttaatctcctgcatattgctagccagttatgacagcgccatttattaacgagaaagtcctttgcccattgcttgcttttgtcacctttgaggaaaatcagatggttgtaggtgtgtggcattatttctgggtactctattctgttctattagtctatatgcctgtcgttgtaccagtaccatgtggttttggttactgtagctgtgtagtatgatttgaagatgggtaacttgatgcctccagctttgttctttttgcttaggattaccttggctacttgggctcttttttgcttccaagtgaattttaaaatagttcttttctaattctgtgaagaatgtcattggtattttgataaagaatagcattgaatctgtaatttgctttgggcagtatggccattttaaccatattaattcttcctagccacgagcatggaaagtttttccatttgttgtggcatctctgatttctttgagcagtgttttgtaattctcattgtagaactctttcaccttcctggttagctgtatttttagatattttattcttttggtggctattgtgaataagattgcattcttgatttggttgtcagcttggatgttgttggtgtataggaatgctggcaattgttgtacattgatttgtatcctgaaactttgctgaagttgtttatcagatcacggaacttttgggcagagactatggggttttctaggtatagaatcatataacctgcaaacagagatagtttgacttcctctcttcctatttaaatgacttttatctcttcctcttacctggtttctctgcctaggacttccaattctatgttggataggagtggtgtgagttttgtcttgtgctagttttcaaggggaaagcttccagccttttccattcagtatgatgttggccactggtttatcatagatgacacttactgttttgaggtatattccttcaatgcctagtttgttgagggttttttacgtaaagggatgttggattttattgaaagccttttctgcatctatggagatgatcatgtggtttttgctttttgttctctttatgtgatgaatcacatctattgttttgtgtatgatgaaccaaccttgcatcccagtataaagcctactttattgtgatggattagctttttgatgtgttgctggatttggtttgctagtttttgttgaggatttttgcgtctatgttcatcaaagatactggcctgaagctttctttttttattgtgtctgtgccaggttttggaaacaggatgatgctggcctcatagaatgagttaggaaggagtgcctcctcctgaatttttggaatagtttcagtaagaatgataccacctcttctttatacattgggagaattcagctgtgaatttgtctggttctggactttttctagttggtatgctttttattactgattcaatttcagaactgattattgatctctttagggattcaatttcttcctggttcaatggaggtcatatatttccaagaatttaatcatttgttctagattttctagcttgtgtgcatagaggtgtccatagtagcctctgacttttttttgtaactctgtggggttggttacaatatctcttttatcatttttgattgtgtttatttggatcttttcttatttttttcatatcagtttaactaatgatctatcagtcttatttattccatgcaacaaccaactcctgaattcattgatcttttgtatgttttttcacatcttgttttttgagctttttgttttgttttgttttgtttttagttgtcctttgattttggttatatcttatcttctactcgctttggggttggtttgctcttctttctctagttccactaggtatgatgttaggttgtagatttgagatttttctaacttttaatgtgggcagttagcactataaacttctgtcttaacactttcttaactgtgtcctagagattttgttatgttgtatctttgttctcgttagtttcaaagaatttcttcatttctgccttaatttcattgctaacccaaaagtcattcaagagcaagttgtttaattcgcatgtgatttcatagttttgagcaattttcttactgttgatttctatttttattgtgttgtgatctgagagtgtggtgagtataattttttttgaatttgctaaggattgttttatggccaattgtggggtcaattttagagtatgtggcctgtgcagatgaaaagaatgtatattctgtggttttaggtggagagttttgtagatgtttttaagtccatttggtcaagtgttgtgttcaggtcataaatatccttgtaagttttctgtcttgataatatgtctaatactgtaagtagagtgtttaagtcttctactatattatatggttatctaagtctctttgtaggtctctaagaactttctttaggaatctgggtgctcctatactggatgcatatatatttaggatagttaggtcttcttgcaaatcgaaccctttaccattatgtaataccctttaatttttaaaatatctttgttggcttaaagtctgtttggcttaaaatctattttgtctgaaattagtatactaatccttgctttcttctgttttccatttgcctggtagatttttcttcatccctttactttgagcctatgggtgtcattgcatgtgagatggggtctcttgaaggtagcataccattgggtcttgcttctttatctaactcaccactctgccttttgattggagcatttagcccatttatattcaaggttaatattgatatgtgtaaatttcattccttcatcatgttgttagttggttactatgcagacttaattgcatggttgctttacagtgttaatagtctatgtacttaagtgtgttttcaaagtggctggtaatggtctttcctttccatatttagcactctgttcaggacctctcataaggcagttctggtggtaatgaattcccttagcatttgcttgtctgaaaaggaccttatttctcctttgtttatgaagcttagtttagctggatatgaaattctgggtaggagtttctcttctttaggaatgctgaatcaaggccctcagtgtcttctggtttgtagggcttttgctgaaaggtccgtggttagactgatggggttcccttggaaggtgtccttccccttctccctagctgactttgggaatctgtttactatgtgtcttggagatggtcatcttctgtagtaccttgaaggggttctttgcatttcctgaatttgaatgttgccctctctagtgaggttggggaaattctcatggaccatatcctgaaatatgcttccaagttacttgctttctctccttctctttcataagtgccaataagtcatagatttggccactttacataatcccgtattgcttagaaatattgcttattctttaatcttcttactttatttttgtccagctacgttattttggaaaactggtcttcaagctctgacattctttccccaccttggtcaaccatatccatgcagaactatggtaaagattacataccaaaaatcagaacaatttccatttaccgaatgctgaccatcatattatgctcgacattcatgaatatcctctgttgtggaaagcaatagtgcagtttgaaaaaaaaaatcaatgctgctacctgagggaaaggcaagtgagatggactttgaaagggaaaagagaaagtgaacccaaaggtccaaggtcaagtataccctccaacagatcagagaaaagatgaaaatacagaatgagtaaggttgtgtgaaatttaatgaagaaagaaagcaaaattgcagtagcaatagtatcacaagaataacccataagtgtgagtgtacctgcattcaccctgagatgcacaccaaacccaaacttcccttctcccaactaaataatcacaagttctttatctgcctccaattagatgctgaaggatagagaaaaaagcaaagaaaagtctaaagttcaaaacataatgcacaaaacattttatgactgcttactacttgctgtatcctggtgataaagagaagcagtagaaagaaaatcacactaggaaaagagatctgagagttgaaaggcagcttcccagaatcaagccaagtatatgttttcatgttatttgtgttgcatgcttccactttaagtcataggtacttgcatgtcaaaggtactctgtaagcactaagtgaatcaaacagaatgaaaggggagagggaagatgagattcatttagaagaagaaataagaaggcaatttacttttgcataggtgggaacatagttcagggctctttacactggctaaaaaggaagaaaaataataaagagagaagggttgccaatcacacaaatgtaaatgttcaaagatatatgagatttgaggtggaagatgtatgatcgtatgtgtgatttcctcagtgacaggaaatatcagatttatgaatatactatgctccattttcatctgtaagaggaatttgaaaaggaaatattattttgggtcatgacttgtcttctgcatataataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagattctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgtttttaaaaatgaaaataaaaatctcagtgcaaagaatacatttacttctctagtagactattaattgcagaatcgcaatacatatgatctccttcttctttgttaaccaagtctcaatcacatttggttaacaaataaaatactacactccccgtcatcccttgtagcgaaatgagcttataagtctaagtcctgcccagtgagatgtaagcttactattttgtgacagtctttctgggaaggctgcttaaagggagccaataagtcaaggagaaaggataatcgtttatccttccccacctcttcctgctacaacagaagggatggctggagctatagcagccaatttagactatagataaactcaaagaaggaagctccatgctaaaaatggaatataggaagaaatagactgtatcaccgataacgtcctcgtgccaccagaatgatttatcttcaaacttctcttttaactgaaaaaaaaagtaaacttctgttttgattaagccactctcattttcattattatttccttccctggttatacacatttaaagcttattccaactgatttagtacttggaagtaagtttcttcaagtatcagaaactaaaatgtggcactaaatgtgtaatggaagcagagctgcataggtgcatagcaatgactcagataatgaaagccaaaaatctcatgatctttataataaatctacaaaatatttagtcaagtcatcacctgctacacattggaagccaaccacatgctgccaaaggctacatatagtattaggagaaatggtaaaatattggtatgggttgtcagaaaaatcctagcatgacaaattcgaggtggaactaactacctggccagtctcagagttgaaacggaaagacatgcacctttgctaaggaaggtactctttgcctgtaacccacaatctcagttgactgagagtctggtaatttgaaaactttcatggttgaaaaagccaactgcctataccccaaattgaaacagttaaaagaagcgtctgaaaattctaggcttagcgataaatatgacttttgccacaccatacaaaagttgtgagcctgctggcaaagataatgcattacttcatatgttctcaatgcagcagacagcaagctgaaaattatttagatgcacagagcacagaggtctgtaaataaaagaccagggtcttcaagcttaataattccatttacccaaggtcattgactgtttattcacacttggagatgaccaaaaaacaactacgctgaaagtctgtcatactttttagggtatcttattgtccaaaactaatccagtgggtcatgaacccgtactaaaaggaagtggcttgctacatatgtgcagtccttagtgaagatattctcctgaatgtccatttcagatgtggccacagaggacaacagaaaaggaagaccctcctgaagagcaaatccaggggccacgaaagaaaatgaacaagagaatttttattgaagagcagaacctgggactgccagatggaccaactaaagaactcacttcacaactagggcagtgagtcctcaccatttcttctcagcaagagttggctgctgtaaaatcagagagattattcatgccttatggttaataaaagtatctataggtaactgaaccttgaggagccaaattgaggcctgatgaaggagactgtacatcatccagagagaatgaacttggagcaggatgcaaagactgcaggggagaaatcagggtttttctgctggaggaagaagcagagggtacatagacataaggtatccaaagaagcccactatagaagctgggacagattgcatacttattctcaattcttcactcctccctatgcagtagagcagagaaaatcgagtatacctgtgacttgctttgaccagtggaaagttagaggggacaagagcacaggctttaaacatgcccatatgggacttctgtgcctaccatgagaacatgccccataattgttaatgcagggagaatgaggagatgtggtgcagactcttagccaatcccaagagctgggttcaagggtagccaacactcatcctagagaagtgtcccctctgacctgcagacacatggccaagaaaaatcaatgcatgttgttgtaaaccattgcatttcaaggctgtttgtgatgcagcatcctggctaataaaccagccaggtctattctaacaattgtagctcagagtaaagaatgtgggcatctcatcagcagacatgatcactaaaaagacagagaaaagatacaatgagaaaactataagcaaactcttggaaatccaacgaacaaaatagaagaaagaagaaagattaagaaatttctagaaacatcctacagtggtcgggaagactgagatattaagcctaggagataaaaatggacaggcagattcatatcatgcttaaaaagaaactgcaaatgattgagaagttttttttaaagtggaactatttcaaaagtaagaaattagtaaagggacaaagttgttaatgcaccataaacaagtgatcaaaagcagaaaaaaaaatgaactgctgtggaaatggacacagtgtgatcctatttttagtggactacttgagttttttaaaaaattaggaggaaggtaaaaggttcagaaaatagaaacagaagtgtaaataatactatgaaatgggcctagctgaaacagctcacttttcaaaagaatacattaaatgaagaatacagaatgagatccttaaaaaaagaagtcaggaaagtattacatagagtaactgcaaaggccttctctccttataacacggaaattgatgtatttgagaataagggtattaaaaaagatctttaagagtctacaggaaatagaagagctaggacaaagcatggatgtcatgtagaatattttatgataaactgctgacctgagccaataattcttgggctggggaaaaaaactgtttctctatagataggtgggtgggggtgagggtggggagggaaaattgtaatgcttactttctaaatagatttcaaaggaatgcgggagaacacaaagagaactagcttgcattgttttttttaatattagcattttgttgataaaacagaaagcaggaagaaaaataatgaatcatgcatatagtaataaaaaagtgtggtaggtgattaacgtgttaagagtcaagggaagaactcatcagaagagtaaaagaagagaactgaaaagcaaagggggacaatcaacaaaatgtgaacatacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtgcaatactgagcgctactccttgaaggtgaacaacatagaaatattgttcagtgcaactcaacaaatgtttatttaacgactgcaatgtactgagcaaattttaggctctggtaagacacatcagtaatgaagacaaacatatgcattaactatatcaagcaggacaaagggctctaaagagaatgaatgcagttctccaaacagagatctctgctgtcactattgaatatcttgtaaactctccagaaacgtgtatgtgcaagcatgtgtctgtttgtgcatatatatatatgtgtatattttaatgctacacatttgaagataccttattacactattcatgactttgtgattttctcttaacacagcaatttggagattaccccctttcagaacatagagagagctacttcatttctcccaatagcatattttattgcatggttgtgccataatttattgaattactggcctttaatgaacaattatgccatttccagtcctttcttattcatgtaatgcttattcatactgtgctttacatatgggctaatatacctgttaacacaaatcttgagaagtgaaatttctgtcacccggcaagtgaatttttaattttgatacatagtgccaaatagccttcaaagtgaaacattcacttatattcccaccaacagtgcacaaaattgcttttgtcctcaaacttcctgccaatgccatttattatcaaaccatttgatccttgcaagtacagtaactaagaagctatctcattgctgtttgaattacaaactacaaatctcattgtagtttaaaatacaaaccataatggtcttattatgagcaaatatgagtaggtttttacatatttaaaactcttttgagtttctcttactgtgaattatctgtctataatcttggcctatttttaaaaattaataagttagaagaaatgagccaattttcatatatcttggcaggtttttccagtttcttattttccattcaaatttatttatggttgttttaaaccattttgacattttgatctttttttaattttgagattattgtagatttatttgcagttttaagaaataatacagagagaattccatatacctttcaccattttccctcactggtaacgttttgcataactacaggacaatgtcacaagtaggaagttgacactgacacaatgcatctaccttattcagatgtcagatttacattcacttgtgtgtgtgtgttagttctacacaatgttgtcacagtgcaatttcctgtgtgcactactgtggtcgagatacagacttgtgtttcatcgcaaggattcccttgctacccttttctattcacagtccctccttaagccctgacaagcacacatctgttctccatctctataacttggtcacttcaaaaatgaatggaatcatggagtctgaatggaatcatggagtatgcaatattctgagattggctttttccactcagtgtaattgtcctgcatttgtaaaaaaattggcatttcgaattttggtactatgctatttagcttaaggttcataccaaactttaattgtagatttaaactttttcattgtctttcgtttggtagtttcatgcagttttccctaaagtggaccttgtataattttaataaaattactcttgcttgcttttagttttaatttgtttacctatattttgcttcctgcctttattgattttagatgaatatcataatagcacctgtgtcattttgtggtccaaattggtggtcttttaatgagcaattttatctcattgatatttactgatatggcaattagctgtggcattttatttcaagttctactttctgtatttaatgccatttatttttgctatattgtctatatttcttgtatttgcatgttttacttttataatttggaaagcatattctcttcttcagattttctggtagtaacataatatacacataatatacacatataaatatatatgtatacatttaaagaaaggacatgagaaatgcacatacaattctgcaaaagaacaaatagaaaaaaggtaagaacacatcaaaatatttagtcgtaaaagacatgaaaattataagaaaacccttctctgagaattcaaagaaattttttaaaaagtcttctgatacatatatatgtatatatgtatgtgtatatatgtacacatatgtgtatatatgtgtatacatacatgcatatatgtatgtgtatatacatgtgtgagtatatatacatgtatgtagtatatatacatgcatatatatgtatgtgtatatatacacatatctatgtatatatgtatatgtatatgcatgtatatatgtacatatatatacacatatatatgtatcagaagactttaaaaaattttctttgaattctcagagaagggttttcttattttcatgtcttttatgactaaatatttttgatgcgttcttaccttttttctatttgttcttttgcagaattgtatctgcatttctcatgtgctttctttctgtttgtctttgttatttttgttgtttttccccaggccaactatgcattagaggataatgttagaaagcacatcagtggagtgagttagatattcaggtagcttgcattcaaatttgtgtcttgaaatgtttcccaacaaaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccaccttctctgacattcttttctgcccagcaaggttagtgatgccccagactctgacacagcagctaagcgcttgctgttccaaagtggccctgatgacatttcagaaagtgtaacttacctttggataattctgcgtgctttctgtgaacatggaggcacacacctcctgctgctttcctcattttaactagatttaaatttcataacacttttacagccctccaggttttcatttctgcttctttgttctctgttttggttttaagttggtttcaaagaacggggcagaaatgtctttactctgccatctttaattggttcctgtactctttaatacattttaaaattaaagccagagaaagaataattaaacttccatgctgcaacccatagaagttccaatttcttgtgtatacagactctctctctctgcatttttaagaagttccatacacttttaggaagacttactgtcttctccaccaacctgagacacgtacccctacaagggtacatgaaattccactcaacattctgtgagttcacaccaaagattcataaggctacacattgttccttctatcattttctaaaaggattttcttctcatattttcttgtatggttataaataacatgttcctgttcacagtttgtatttagaacatttgctaggcattttgttttcaatcataatccttagagccttgaaacaaacaaatcacatatactgtatagaatgatatctgcttggtatttctgccttaggaaataatgttcatttttgaggcttcattttaatgtacagcagaatttagtgatatcacaatcccctacacagttctagtaaaactaaatgaaacagtgtgaagctcctagctttatctgaactcccatgtctgaaatctgtcatttgttggtgtttagtttgcctggaatgtttgtttacctactgcctgttgactagcttccaaatcctcttgatgagttgatttcataacagctgaaaataacattgcattcctcacctgtaacaggtggtccccaagtggctgtccatcttcccttgtgttctctgctgtgaactgtaaatcatgtcaagaaacgacaacccattagatgacatgatctaccatcactgcgaggagccacccgtcacaacatgcacacactttatccatcctatgcgcaaataataaatttggtcaaaagattgccatttcatgttctggaaaacatgaacttatgtgagcttatacataaaatattttaatctataatctcatgtatatgtcattatgtcatatttcccagaattcagctgccaaaaataacattaaagaagtagttcatgtcaggtaagatgagaatgccccataaatactgattctgaacctctagcagccatacatatgttaattcattattccacaaatattttgtgcacatattctgtgccaaacactgtgctaggtccgaagaataccaaaattaatcattacaaactcagagtccaaagaaaaaggcagactcacaaataaacagctgtaaaaatgtgtgttgctctatttggaggtattacgtagacattagggagagagcatctgtattagtccattttcacactgctgataaagacatatccgagactgggcaatttacaaaagaaagaggtttattggactcacagtgccacgtggctgaggaggcctcaccatcatggcagaaggtaaaaggcaaggagaagcaagtcacatcttaacatgaatagcggcaggcaaaagagcttgtgcggggaacctccaccttataaagccatcagatcttgggagacttattcactatcacgataatagcacaggaaagtcctgcccccatgattcaattacctaccaccaggtccctcccacaacttgtgggaattcaagataagatttgggtggggacacagccaaaccacatcattctgccccagcccctcccaaatcttatgtcctcacatttaaaaaccagtcatgccttcccaatggtccccctaagtcttaactcatttcagcattaactcaaaagtccacagtccaaagtctcgttcgagacaaggcaagttccttccacctatgagcctgtgaaatcaaaagcaggttagttacttcctagatacagcagtggtacaagcattgggtaaatacagccattccaatagggagaaattggccaaaacaaaagggctacggaccccatgcaaatctgaaacccagcaggacagtcaaatcttaaagctccaaaatgatctcctttgatcccatgtcttgcatccaggtcaggctgatgcaagatgtgggttcccatggtcttgggcagctctgcccctgaggctgtgcaggatgcagcctcccctccctgctggctgctttcatgggctgccattgagtgtttgtggcttttcctggtccacagtgcaagctgtcagtggatctcccactctggggtctggaggatggtggccctcttctcatagctccacgaggtggtgccccagtagggactctgtgtgggggctccaaccccacatttactttctgcattgccctagtagaggttttccatgagaggcctgcccctgcagcaaacttttgcctggacatccaggcatttccatatagcctctgaaatctaggcagaggttcccaaaccccaattcttaacgtctgtgcaccaccaggctcaacatcaggtaaaagctgccaaggcttgaggcttgcaccctctgcagccatggcctgagctctacattgacacctttcagccatggctggagcagctgggatgcaagacaccaagtccctaggctgcacacagcatggagaccccagattcgacccactaaaccatttttccttctagacctcctggcctgtgatgggaggggctgctgtgaagacctctgacatgccctggagacagtttccccattgtcttagagattaacatttggctacttgttacacaaatttctgcagctggcttggatttctcctcagaaaatgggattttcttttctatcacattgtcaggctgcaaattttccaaacttttattctctacttcccttataaaactgaatgcctttaacaacacccaagtcacctcttgaatgctttgctgcttaaaaattttttctaccagatatcctaaatcatctctagcaagttcaaagttccacaaatctctagggcagcaacaaaatgctgccagtctctttgctaaaacataacaagaatcacctttgctccagttcccaacaagttcatttccatctgagaccaactcagcctggactttattgtccatatcattatcagcattttggtcaaagccattcaagaagtctctaggaagtttcaaactttcccacattttcctgtcttctgagtcctccaaacggttccatccaatctcttcctgttacccagttccaaagtcacttccacatttttgggtatcttttcagcagtgccacacttcccataccaattcactgtattagcccattttcacactgctgataaagacacacctgagactcagcaatttgcaaaagaaagaggtattggacttacagttgaacatggctggggaggcctcataatcatggcagaaggtgaaaggcaagaaggagcaagtcacaatcttacatggagggggtcaggcaaaaaaagcttgtgcagggaaactccaccttataaagccatcagatcttgtgagacttattcactatcctaaaaacagcatgagaaagccctgcccccatgattcagttacctaccaccaggtcactcccacaacatctgggaattcaagatgagatttgtgtgagaacacagccaaaccctatcagcttcattctggggtcaggtggtagggacaacacaaacaccaagataagttcctttggagatatggcatgagctgaggcttataggatgaataagaagtatgcttggtaaaagagttcaggcaggaaggcattggggagtggcatttcttggtaaaggagttcaggcaggaacacattggggagtggcatttattgtataggggaaggagcaaaggtatagagttgagaaggaggttagaacacgcaaggaactacgagcaatactacaggagtttacttagtgatgctggggccagtgagatatgtggagcagtaagcaaaaggcaaggttgaggagcactccaggaacagtacgtaggaagccaggctggatcctgtggtcaggagcttctgaagagcttgctgttgtggatatttgcttgcacttaaataacttttgtattagtctgttttcacactactgataaagacacacccaacactgggtaatttataaagaaaaagaggttgaatggactcacaggtccacatggctgtggggggcctcacaatcatggtggaaggtgaaagccatgtcttacatggtggcaggcaagagaggatgagcgccaagcaaaaggagaaaccccctataaaaccatcagatttcatgagactttttcactaccatatgaacagtatgggggacaccgcccccatgattcaattatctcccaccaggtccctcccacaatacatgggaattatgggagctaaaattcaagatgatatttgggtggggacacagacaaattatataagctttattgaggtttaatttacatcttaagattcacttaggtgaacaattcaatgattactattaaattgacagagttgtacaatccttaacacaatacaggttttagaatatttccatcattccagaatatccctcatagccatttatagtcactactgactcctacctccaagaaccaggcaaatgctcatctgctttctatgtctatagatttgtcatttctggacatttcacataaatggaatcatagaatatgtagtcatttgcatctggtttgtttcatcaggcatcaggtttttttagatttacccacgctgcagtatgtatccatagcatatttgtttgtattgtaaaatagtattccatggtatggatataacatcattggcttatcttttcaccaattgatgggcgttcagattgtttctattttttggttaatatgactaatgctgccacaagcattcacatgcaagtctttacacagacatgttttcatttctcttgggtagatatttagggatagaattcttgggtcatatggtaaatttatgcttatctgcttaagaaattgtcaagctattgtgaaaagcagctgcatgattttacaatcccatcaacaatgtctagggttctagtttctcctaaggagttttaacgagacggataatatggctagatttgtgctttaggtaaatcaatctgatagctactaaaaatgagactgaaaataatgagcctgtttaggaagatgttacaataatctaggtgagatctctactacgattcccaactagaccattggaggagaagattatctcagaagaagaacaatgctgctgaataagaacaggtgatttgcttccatcagttgctcagccttgggaacgtgacttaccgtggtgtgaggacaaagcaggtacctgcccgccagccagattagctgaggaaaatacacttcaggtatgtaagcttatgccttcacatctgaaatgtcctgtactaacatatacaccctcaaactttccaacacttatactatcactgtgtcattttttcctggttcaccaactgcatactggacacagtgctgcacatgctattgggtatttttcctactttagagattatgttcatttggttctaaggataattgcaagaatattgttgtgctataagtaaataaatgctatgtatttataaattatgtgttaaaattatactatttctattgttagcacacacagtattaagtcatgtggcccaaatctcatatttcatagcatattatggttttattaggatacagtaaattaatatttcagtgagaaagtatttggaagtacccataagccttatcaacagctcatcccaatgtttcccttcaaacagccacgtggaatttgtgtaaatgagtctaaatgaatgataaggacaatatgatgtttgagttaaaatatcttttgaaactgaaaatgagcagctagccaaaaaaaatctgtcactttaaaaagatcaggaaaaagtcttaattctgccattgtgcaatgtatagcatgtaactaagaacaatatctaaggacaacaaatataaatattgaaggaagttgagtaatatttaattagattatactatatttggtctaggaataataaacctgtaaaattatctacactatgaaactaagctctgtattataacatataaatgagttctctgatcttttaaaatatgtatttctaacaaccttgtaaatgattaatatttcaaaatactgctactactgctgctactactagtaataacaacaattttgaatagccttgaatgtcttaaaagttgtaaaatataattttattcatgatgattaagttccatgtgaataagagaaataaaatgactacaaatatttaaccaaaaataaaagaacagagggtttgtcaaaagagaccaatttacttattaaatagaatgaccatacattacagtttcctggaatgaaacacttttataactattgtcctgatggccaatccagtttagcattttgtccttgattgctttacctttcaacaaagtattattatcaatgttatgattattgttatcattaatgaaaataagccagatggacttttacaacctctacttcatactcccaatctttgttataatcatgtctaagtagcacgagacaaattcagggaatgcagttctcaccttaaatgggagttaatcttaaagaagaccagcagtaataacctatctcttcccatttcagactcaacgtaaccaatacctgcctttcaaggaaaactcatatggggctcactgacgaaacaaagcgagtttgcaaaaaaagatttgacatagtcaattctttgtactcttcagtgatggcagctgccttagtggaaaatgtgggaaattacagattggggtaggtgaattgaagataaaattatttatttttgttgttataaatacaaattttgatataatatagcatcatgtgtaaaacaattttcctaacttaagaaatatgtggaacagaaatatttgaaatgtggtggtgtacaaggaagtgagcttgaagaaaagagggtcccaaaaattcacgttttacaccaagagaaataaaaccgtagtagtcacaatttatgaatatttttacacttgtatatatatacttgtgtatttgtgtgtatacgtatttgcaactgaattataaactttaatgattaagctgatttgaaataattttaggaaatactttagtatggcaatacatacttggtctttttgttgcccataatcaattagatttgagaaataattaacctttgaataacctctttgcaaatttacttagttatcctagcaaagtattaaatattttgtaaatgagtcctgacatttctgattgtatgtttttcaaaattgttggaaatctttaaacaaaatcctggagcatccaaatttcaactactaaagattataattttttgagcacccatatttcaaatatgaaagcttttggcaaattgcatttattgaaaataaagctttcatacaggaagatattgatagctcttaaaaagcaagggatacattgaattgattagatgataagtgggcaaatggtatggaggatgtaattttaaaattctctaagagcatattgaaatgtattaacttttaggaagaattttgatgagcccctatttttcagtaaatttctttttaaacttgtattacattttattttgtctctattttttgttattattattatactttaaagttctggggtacatgtgcagaatgttcaggtttgttacataggtatacatgtgccatagtggtttgctgcacccatcaacccatcatttacattaggtatttctcctaatgctatccctcccctagcctcccacccaccaacaggcccaggtgtgtgatatttccctccctgtgtccatgtgttctcattgctcaactcccacttatgagtgagaacatgcggtgtttggttttctgttcttgtgataatttgctgagaatgacagtgtccagcgtcatccatgttcctgcaaaatacatgaactcatccttttctatggctgcatagtattccatggtgtatattgccacattttctttatccagtctatcattgatgggcatttgggttacctccaagtctttgctattgtgaacagtgctgcaataaacatacatgtgcatgtgtctttatagcagcatgatttataatcctttgggtaaatacccagtaatgggattgctgggtcaaatggtatttccagttctagatccttgaggaatcaccacactgttttccacaatggttgaactaatttatattatgtaccattatagaatgaaaatgaagtcaatgatttgatggtaaagagctgcatataatatgactaatactaaaataataaataattttataagaactgaggtataggcccaccagcataatcaatctaattataactatttcaaaaattctattattctaattattcaactatctgcatttactatcaaaaatgcttcagcttgagaataaatgatatgatcatcccagttttgatcaagtaactattggtggacacttttgtgcaactagatcctaaaataataaaagcctcttttcttcatcatgatagaaataaaaattcctctttccaagtgtctctttatgctcatcctacaggaaattcaattaaagatattatacaatactggatgttaaggctctcaatcaaatgttgccatttatttcattaaattgtcttcgtaacaggctaattaaattattgcccagtttagaatgtaatttctatagcttatacaaccaaacttaatatccttaataattcaaaaacagctatatttttatacttgaaaattgtttctgcatgttgaagattacagatttgcaaatgttctggcaagtgtgagcctctttgaaagtagatcatatccttaaatgaatagcaaataaatcacagccacaaaattgcgtatattgcattttgcaactgatagcctcttagctgctcagactgttatttaaataaaatgaataattagagcagaaaactgaagagaaggtgttatttttatctctgtactcaatagaatgttttcaagacaaaaattagtaaggagcatgcttgctcaatttctttaactttaaatcaatgtttactctctgaacacttatattgtaaatgttaagtagaggcttagaaactgataatactaataataaaaaatgaaaaattgagtaggctatccagttatttgccaatgtttaaaagctatttggcatattattggcacaatttagctgacataactcaggtgcttaatttcattaatttcaagatagtcaaaacatttggcatgaagattaaaggaaactcaaaatataaacagaattaaaataacatcataaaaatagtagttgccgaaataatgaaaaaagtgttaatagcaataaattaaggcacacatcaatcaatatgaaaacatactataaatgatgtgaacaaaagatacaagttaaagaggcaaacagtcaataaatatgcgaaaaattaaactcacaaataaataaatgcaaattaaagtataagcataatgaaatttttgctctccaaattaacaaataatttattatctcatttctctctgtggacaagaatatgaaaaagatattctgataacctcctggtgaggcagcaatttagtataattttttgaaaagtaatttaaggccaggcgcagtggctcatgcctgtaatcccagcactttgggaggccgaggtgggtggatcatgaggtcaggagatcgagaccatcctggctaacatggtgaaaccccgtctttactaaaaattaaaaaaaaaatgagccgtgcgtggtggcaggtgcctgtagtcccagctacttgggaggctgaggcaggagaatggcatgaacctgggaggcggagcttgcagtgagccgagatcgcactactgcaccccagcctgggtgacagtgcaaccctccatctcaaaaaaaaaaaaaaaaaagaaagaaaagtaattttaaaatacatattaataaagatattatacagtatctttgtatgtctttgaccatatgtctatttattttaaaaatccatccctaattatcagaaatgtgaacaaagatttatgcatagtgattttaccgctttttagttataaaaataaatcctgagtatgacctaaatgtacagcaatagagtaatagtttaattaagatgtattcatagaatgtaaaaagtattcaatgatatgaaacttctttatttttaagtgaaaaatgatggcaaaaatatatacctccaatgtatctatgtctgtgtctatctaaatatgttcatctatcaatgtatctgtaaccctttatgtttacaaaattaaaacttagaagactatatctcaaaatgtcatttcttatttgcatcactgttttgacaatgaaaatgtatatttcctttacaatttgagagacattttacaaaaaaattagtccaaattttgtttaaaatgttaagagcagcataagttttgtaggactttaaagtaagaaagtaaattaaggtttttcataagatagcaattaactggtcattttaatctaaccagtaaatttgaattaatttgctgctaatgggtttgctttagtttaaaagtatatggagtgccttagactcttcaggctactataataatataccataaactgggtagtttatacacaacagaaatttatttctcacaggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagataccacctcctgattcgattatcttcatggttaagatttcaacacatgaacttggaggaacacaaacattcagatcatagcatggactatttgttattagtattattattatttcttaattacaagtttaattaaaggaaccaatagctagggaatacagccaagtttgtttacaagtatgaagaaccaccagtgctacaatcacaaaaaataatctatgaaaccactgttgaaaatatttttatgttatattgcaaaaatcactgaatttataccagtgtttatggcaatatttgcccaatttacaatcggaattatgttggtacttttttatatgtcaaagagaatacaaaagtcgctttgtccttataaaatataatcggtagattaaattttaagctcactgaagtacaaataagctatctagatagtataaaaactagttagaaaaaaatttcaaacaaactgttggtttgagtttttttcttcacagtatataaacatttaaataaaaaactttaaaataaacttcacacccagttttctcatgtttaagaaagtcagtacaaagtagtagttaataaagctggataagaagcagattacctggaactaagttctgctctggcacttataaattgtattatttagggcaagttatttaacttctctgttcttcagtatcctcatcaccaaactgggaataataattgtatctacattaagggattattttaaagatacaaagagctaataaaatgtaaagcacataaaagagtacccaggacacagtaagagcttaatcaatactaaccttaattattgtgccctcagtctacactcatacttttcacagcaaatcttgagtgaatagtatttactttttttcattcatttcagaagcatttgttgagtacctaacaatatttgtaattttgaaggcaaatgttggataagccctggtggggaaaaaagacaaatgtaacctattctgacctcaaataatgcatggcttcatgatagagagaaggatcctataaaaaaaaacaaacaaaccaaaaaagttttggaagtacagaaatgtactggctgcagaggagcaggcaagacatagaatctaggcagggggttgggattaggaagggctagtctctgggaaaatcattcatgctctggggttcaaacaatgcattgaattgtcttgaaaaataaagtgaaatagatatacgggggaaaaataatccacacaggcacagatgcaaaagagattgtgatgcatttgaggaaatggaagaaaactgatttggctaagttcaggatacaggtgggaaagagaattgtgaaaattgtggctgtataactaaggagaggtcagattatgaagagccttcaagtagagtaaacgtataatttattgttgtaccaaactatctttgcaagtgagggggagaatactaattattttacccagaacacaagcataaaacaaaaatctccatagtgacttggaatgtatagtacttctaggccatgattactttcatctatgcatctatgttctctccatctttttttttttctttttttgagacagaatcttactctgttgccgaggctggagtgcagtggtaagatcacagctgactgcaaccttgaccttctggactcaagcaattctcccacctcagccttgcaagtagctgggactacaggcacatgctgcgacacctagatatgcatttaattttttgtagatatggggactcaccatattgcacaggttgttcttgaacccctgtgctcaagtgatcctcctgtctcagcctcccaaagtggtggtgttacaggcatgagctacagtgcccattggcatcattttacctttaccttgggtacatgtatgtgttgcataagggagcagggagcacagggagaggagaatctcacaggcaagggggttctggtaccagataaaggagatagatacaaagataagccaaaccacaaatgcttattcagcattcttcctgaactatctttcctcccctgaaactcctttttctttgttttcttcttgtgtctttgattacttttttcaatttcctccatggggttctcttttttaatacgaatttttttctttgcttattttcttttctctaactgtatgtagagagatatgaaggcaaacataaccctccctacagtgtcaatttcaatcttattttaatggttcctgaatgtttctcttggtactgaaaccagcccaacttcctcacagaactgatgtttatagtttttagataaacataaaaattgactcaaccaatcttaaaatgtaaaacttaaatttgccttatctgagttcctttctcaggaaacccactctcaggactcccaaataatccataagtatctctgagtgacttttaggtgcccagtaactatagcctttttcacaaatcagggtctcatatctaatgctgggtccagtaagagactttaaacttcatcttaggccctccaatatgactataatatttgcatgtcactaaaatattgtggtgttaggaaggaagaaggacaagagaaaaattcaaagaaggaacttgaaaacatttttaaagttctatgtaaggaattccacaaaaacaccttttatatttttttcctgcaagaataagaaaatccaacgcaaaattgcttaagcaataagcaaaatgtattatttcacatattaggaagtctaaagtttgaaaggtttgacagttagataattcagtggcatattgacatcatcagtgacctaagtgttttctatctttatgacctgtcatcctcagtgaattgctttgccttttatggacccaagatgactgtaaaatgtagagaggcataaatgcagtctttccttctatgggtctccttaatggactttatccagatggttcccagcagatgtctcttttcagcctatttaccagaactgtgtgacaagaccaagccaacactatcaaggagaatgttcttgatctgattcttttaacccatctttatttacttcttggagctaaaaataatccagagtgcagggacacgagatacctgaacaaacctgagcttctattaataaagaaggtggaaaatagtggtttacaggaaaacagcagtatctgctacattctacattcattctaggttataaaacagttcctcacgacagagctagacaggtgtagaaccatacacgatcaagatgcagcaaatcaaagagctgtgtgtctaagcatctgaaatccatctttgacaatgactatatacatgatatgaaaaaaattttaaaaggttaagtgatagactgatttgagttgaatctaagccgctcttcatattagttgttctattccttcttatgctcctcactaaacctcagtttcttaatcaatagtcggataaaaatagaaaaataatgagaggaaagttctctgtggtaacacttatatgattctgtagtagtctgactgtttgtgcctttaccttatgacactataaacttaatagacttccaactcccagtcccacatataaggagcttagaagccaccactccatcgtaacaataggtaaaaagctgaacaaactgaaaagtcaacaattctttttagatccataaaagaggtgaagatccaggcaaactagtggctccaagattagagagacacacagacaaatacagaaaggggagtcatggcttatctaaacagagacttacaagtggaaaccactgcaggaactagtgccagggtagaaaaacctaaactgtaattgatgaattgctggagaatcagcgtggacaagtcagagtttacagctccagaaggacctaagcataagggagactccatacttttgtgtcttttatctctaagaacttgacccagtaaatattggataaaaatttctttgtgctttcagcaaagtgaggggaaaatgaatcattttgaagcatgctagaatactctcttcttaaaaaggcctccctgaagaaaaactaattaactagaccctaatttcataggagtattatcatagtctaactaacctggaggaaaggagatacccgacttcagccaggtctattattccacaaggcagaaggaaaataccaatgtccagcccactgtagccatcttgtcccacctaaaagcaaagaaaaagctgagatatacttatgaagtacagtctagaggcataggatccctgaaagacttggaactaatcatgagactatgaacatttctcctcccacaccttaccaccacattataaatacttatttacaaaaagctagttccttgaaaagatcagtaaaattgataagcctctaaccaggctaagaaaaaaagagagaggacacaagttactaagtaaaagaaataaaaaaggatatatcactatagatcccatggacattaagaagagaacgaaagggcgggcgtggcagctcacacctgtaatcccagcactttaggagcctgaagtggggggatcatgaggtcaaaagatcaagaccatcctggccaacgaggtgaaaccccatctctactaaaaatacaaaaattagctgggcgtggtggcatgtgcctgtagtcccagctacttgggaggctgaggcaggagaatcgcttgaacccaggaggtggaggttgcagtgagctgagatcacaccactgcactccagcctggtgacagagtgagactccaactcaaaaattaaaaaaaaagggagagaataaaataatactatgaacagctctatgtccaccaatttgataacctagaggaactaaactaattccttgaaagacacaatctgtgaaaactcatgcaagaagaagtaaataatctggatagggctatactttttcaataaattgaatcaataacacataaccagtcaaaacagaaggcatcaggcccaaatttattcactggcaaattctaccaaacatttaaggaacaaattgtattaattctctataatctctttcagaggatagcagagtaaatgcttcctaacccattctattaagccactattaccctaagactaaaatcaaacaaaaacattataagaaaagaaaaccacaaataaagatctctcatggacatagatgtaaaaatcctcaacaatatattagcaaatttaatccaacaatgtatgagaagaattatacaccattaccaaatggaatttattccaagtgtacaaggttggttcaacacttgaaaatcaattaatataatccaacacatcaacaggatataaaaaaaaagatcatattaatagatgcagaaaagtcatttgacaaaattcaacatacatttgtaataaaaaaaaactcagtaaactaagaaggaaatgttctcaacttgataaagaatagctacaaaaaatttacaactaatatcatacataatggtcagcaacatttccaaaaagatcaaaaaaacacaaagatgtctcctttcagcactccttttcagcattatattagaagtcctatctaatgtaataagacaagaaaaataaatataaaatgtgtacagattgggaagaaataaataaaactatctttctttgcagatgacaggaacatctatgtagggtatccaaaagaatcaattaaaaaaactcctgtaactaataagggattaaagcaagtttgcaggatacatggttaatagacaaaagtcacttgtcttcctgtatgccagcagtgaacaagtggaatttgaaatgtaaaacacaatacatctacactagcacccccaaaataaagcttgcaggtataaaggtaacaaaatatgtacaagatctatccaaatgtagagaaaataaatcaaagaactaaataaatggagagaattccatgttcatgggttgtacaacacaatgttgtcaagatgtcagttatccccagcttgatccatagattcaatgcaattccattaaaaatcctagcaagttatgttggggatatcaagaaatgaattctaaagtttatatgaagaggcaaaagatccagatagccaatatagtattgaaggagaagaacaaagttggaggactaacactacttgacttcaacatttactttaaagctacagtaatcaaaacagtgtgatactggtaaaagaatagacaaatagataaatgaaacaaaatagaaagctcaggaataagcccacaaaaatattgtcagctgatcctgagaaaggagaaaaaggcaatacaatacagaaagagtcttttcaacaaagagtgctgaaaaaactggacatccacatgcaaaaccatgaatctagatagagattttgcattcttcataaaaactagctcaaaatgaatgacagaactgaatgtaaaattcaaaactacaaaactccttgaagataacatagggtaaaaaatagatggctgtgggtttggctatgatcttttagatacaacaccaaagctatggtccataaaagaaataattgataagctggacttcattaaaattaaaagcctctgctctctaaacagaaagtgtcaggagaatttgaagacaagccacagaggaagagaaagtgtttgtagaacaaacatctgacaaaggattttattcaaattattcaaagaattcttaaatcacaataaggaaacagcctgatttaaaaattggcaaaagaccttaacaggtgcctcaccaaagaaaatatacagatggtaagtaagcctaccaaaacaggtttcacatcatatgtcacaaggaaaatgcaaataaaacaataattagatattactgtatacctattaaaatagccaaaatccagaacactgacaccacaaaacgctgggaaggatatggaacaacaggaacttttatccattgatgaaaggaatgtaaaatggcacagccactttggaagacatttcagcagtttcttataaaactatacatactcttaccatgcaatccaacaatcactttctgtggtatttatctaaaggagttgaaaacttatgtccacacaaaaacctgcacacaagtgtttgtagcagctttacttgtaattgccaaaacttggaagtaaccaagatgcttttcagtagatggatggattaataattcagccaatggaatattcagtgctaaaaagaaatgagctgccaaatcatggaaagacatgaagaaagcttaaatgcatattactaaatgagagaagccaaactgaaaaggctgcatatccaatgatatgacattctgaaaaaggcaaacctatggagacaataaaaaataaaatcagtggttgcctggggaggggggcaggaatggagcatagaagatagttaaactactccctataattctatagtggtggatacatgtcattatacatttgtccaaacctatacacaaggagtgaaccctaaattaaactatggactttgggtgataatgatgtgtcaatgtacgtttatcaattgtcacaaatttgatactctggtgagggttattgataatatgggaggctatacatacacaggggcaggggaaatacaggaaatctctgtacttacctctcaattttgctgtgaacctaaactactctaaaaaatacaaaaaaaaacctctttctaaaaaaaaactctttaagttgaggaatgtatcttcttcattgtgtccccggtagctagtacagtggcagaattgatggcttttaagtatagctaatgactgaaggagcatgttataaaatatttattaaagcctgttctataatatttggcaggtaatagacatttaataattattagatcatagctgatgatttgactcttgacagaactaattgctacttacatttaaataatgctaattagaatgacaggctattggaaagcatgcagaagaaacatatggaagttaataaacctagagtcaaggcctgcccttctcacagttattcaaccctaataaatagctttctcttgctgactctcagtttcctcacttataaaacgagcacattacctacctcataacgctgttgtgatgttgtgatgactaaacatttcttacagttactaagtggctctatgatcacttcaataaaactatgtgccaagtttctatgtaatgatagcctgagaatccccaaaagtattggttgctttccgaccagtcaataatagcttactaatttatctgggatctcatgtgacttgcttcgtctgttccaataaatttagcataaattcaatttgttcaaaacccactactactactactatctaacatttctagtatggctactttgtactaggttcttttctaagtattccatgcattcattcatggaaacacttttattattacattttgcagttgctaaaactgcattttacgtaagacaaaattattttcctgtgtttatacagtttgtgagaagcaaaagcaagttgtatacccaagtttgcctgattccagagtcaggttagttatccaccatattataacaacactcaggcaaagtttacatgtctagttaatgtcaataatggtataaacaggaattaggtaataggccatttttggctctcttagtgagatagtaattaaacattttagctgaaatttctctttactataacataccacttgataaagcatacattaattctagtctggttttgctgttgagaaattatctacatttactaccttattataacatattattcttttcattttaaaaatggccattaggtttatcttacttataatacaaagtgtactttatttattttttaacttttattttaaatttaggggtatatgtgcaggatgtgcaggtttgttacataggtaaacttgtgtcatgggtatttgttgtacagattatttcatcacccaggtattaagacttgtattcattagttattttttctgagtgtattttaatagaaaactaaacactaatgaaatcactgaagatatcataggaatataaaaccctcaagagatgatttagagttttccattttcagttcatggaaggcaaggtttccactcaacagagaaagtacaaaatggcagtcatcaggactaaaacattacaactgtagaagttacacaatgtaaagcttctgatattataggcacaaattacatcatgaaaccatttcactagagcacattagtaaactcagtttccaacggatttcccttggggccctcgccgtattgaaacaatcactatcttaagaagaaaaatgtgttcatttgttcccatgaaccagcacctagcatacctgtcttccacatcataggtatccaataaatgtttcctgaataagcaaatgaagaatgaatgaatgaatgaatgaggaaatagggaattcaaatttcttccagtcttgaaaggattgatagtctatgtggacagagcatagatgtaaatagatttttaagaaaacaaggtgcagacatgaatatttaaagaactttctaaggactacaacaattgatagaaactatctcagagatctgtggggcaggatgtaactccgaaggcttgctatccacttataacctcttccactggctaagggagacagtagggacacactgcatagaaacaggaagaaagcaataattaatgttttttaaagaaaaccattaatagttaattaagaattaagggcccatggtctctgaggttggagtcatttcaaagtactagaaaaaatgagcatagggaagaaatcatattcataagtaccttgctctaatatttccaaatgtacatcaagagaaactgttgcaacttgctgactttaaaattctagccttctctggcttcatgaaaaacttgctagcctcctgcaaagttacagttcaatctgcttcacattgggtaaaacaatacccaaggtacagaggtgctgaaaggcttagttattgttagttatgggagttgacaatcttgaataaaaagcactcttagtgcaaagtagaattgtaatcagtgtcattgtcatttgaaccacattgtttgcagtgtaaccaattgtgaaaccaacataaattcaaaaactaaattagaaaaacagatgcttcttttgtttggagattttagtcccatctagccatattgtatatcattttctttgacttacaccacatagaaagaaaaatcagagagcataatacaaaaatgcagaaacatatttagcaaatttgtggatttcataagtcatttataaactttggatttacaaacaatttcaaaggcttttgaaaatatttttttttttttttttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcctggctaattttttgtatttttagtagagacggggtttcaccgtttttttagccgggatggtctcgatctcctgacctcgtgatccgcccgcctcggcctcccaaagtgctgggattacaggcgtgagccaccgcgcccggcctgaaaatatttatacacacaagaatctctataatactacatataattataccatggcttttccaaagcatattccagagatagactttcggcagaatatcaagtttcctatttggggtttgtcttggagacagtgaacaatttatttttcagtctctgtctccactgatgcttgtgattaagataaatacattggtgcaatgagagaaaagagatttatcttgtacataatttctaaattgacttgtgacattaggaagtcgatctacccagagtggaatttgtttcttcagttcactgaagttcagttcttcagttcactaagttccaactaatttttgtttctccacagtctcaactattttttaaggaaattgcgaagttcacttttaatgtttctgaactaccagacttcctatgatttaaaaaataacaactgtaaatttgcatgaaatctttggcattatatactcaagtatagcttcaattctgggccaatatacaatgctgatttgtgtaggacaaatatctagaaaaataggtatttttgaaaagaagataaatactctaccaatgcaagttcaagatgaaataagagctacatgcacacacacacacaaacacacacacacacacacacacacacatccatctgcatcacatatctcataagcactaagggaaaaaaaacacacttttgtgtttatgatgttaattttaagcaatcaaaagtataagcaataacatatgttttgccaagtttacagtacaccattgtggttataagcatagggatttaagctttgttttcaatagtctgaggtgcttgcattttgtttatatcaacattttacttccaacaatttttttaaaagtcatcttatttgtagtctaaatagttcttggtaaaacacaaaatctcttagtgagtagcaaatcggggccactaaaaataaatttcctctttgttgcaaatgagacaaaaactgttgtatttagactgtgggggcagttaacaaggtctaggaaacctcaacctgctaccccaaaccttttgtctgactacgtggataagaacagatgacaggagagtgggtggcttcctggagagaacttgggctttaactcttattaactgtatttcctagtagagtagcatctgtgcatactagatgtgtaagcttcaacaaatgatcttgccctgagtctgttttattgtctgtaatatgggtaaaatattatatttttatgagattaatttaaggatttgatggcacaatgcatgcagaatcattagcatagaacatatacttgatatttctcaattcttcttgatttccccttcctgtctttctttcctcattttcaaacaaatcaaaataaaactgaaaaagtataaagtatatcacgggaaaatttagaataaaatatattttatttttttctcaacattagaaagtcaactaaaaaatgagcagctatcataccaatacatcgtttagtatagggtagtcagttgacccacacagtaatattaagtcaattcagctgtctttgaataaaaggaaagagtaagcaagcaaaagaaagagagaaagaacaatttaataattacagaggattcttcccaccattctaataatgaatggagtatgaatcacctagcaagcaagagatggcagacatgatttggctttccattcaatcatcacccatcattgaaagatgcttattttcattacaatatgacacctaaattcatgccaactatttcatctgaaactcaaccaagaaaatggcaatctgttctaatgctgaaggaaaatactggttttctagtcttcaacatgacctttcagagagattttcaatggaccttttaaatatacatatatatgattttcttcacacttcataactttagagcttaaattcacatttgtcactctactgtactaatatttaagtacacaacagaatttaacattgtattatcattaaggagcatattagaaagttaaaatattctataaaatatactatataagcaatacatatgttcagataatttgtacttttggttattaaaaagaatttttaacaataggtcatcaaatttttgtagttgaagaaatattttcagattttgcgatttagaattgaaatttcaaaagaacatagacagtaaaagtaaatattagtgaaatattgaactaattagagggaagccaactgagatatttctaaaacaaacaaaaaaactaagtgtatttactacatttgtagggtaatggggaagccaaataattttcatgggtttcagaatgaatgatcaaggtggaaagcatagaaaaatacttgggaacacctgataagcaaagagtaccagccccatacacacacttacatgcaccatacacacccacctgttactcaagttttcagaagtgaagccaccaaaagattaaaataaatattggtgacaaaagataggtgctgctggagtagatcaaggttaatggaggtccttgaactctttgggatatcaagaccaaaaataaaagcttcctttgaagtttgttatctggagaatcagacagacttcttactcttccctggttctagggaccatgtgacaatttatggcaaatgacattagatattaatctttgatatttagtagcatagatcataagcctttttcaaatcaggtagctagaatcatattttcaaagtacaagcccttaatttccgtaatagctacaaaaggtggaggaggacattttattgagattattgttagccagccacccacacacatgggatccaaagtatagtgttctttgcttcatattcaaatctaaaatccagcacatactgagcccatagtgaaatgtgtttacatacacccaacagacgaaagggaggcaacaaaggagactgagaagaaatggctaggattttcagaaacaaaattaggaggctgaggtaatcacttgtctcttcagggatctgctacttcttgaagaggatttatgggatgttacaggtttctgaggcttaccctctgttgtctataactgcttattcatgcaggacaagagaagaaggttaataagtaccctcagggatgtaatactgaaggactttggccctaggtaaataaaaactccaccattttgttcattttaaggctggaattctggtagataagtcaggtaatgtgcagtgaagagctatctatatccagatatcatagaacagattgaggtgtcctagaccatggctcaagatattgcaatgatggcataagatagttggtcaaagaatgaacaatacaagagctgaataaacataaaataaaatgtaggagaagaaaaggaagccatctttaataccagttattataaagaacaaagaatgtgagtgagaaagatagctccttgtaattcagaaaaagaaagaagcaaatgagaaaagaggacataatcagaacttgaggtcaatcagcataataattttagggtatgggtaatcaacagagtaaacttacagtcttattagataaagggaactacatactatgaataataaagcacttatgccatgtgcctcaagcttagaatccagaattggaagtgcataacttaatggaaaaagtccacagaaagtatacaaagctagatagatctatatgtccatgaaatataaatttgtgaggaaatccatgaatcagaaaatggctgcaagctggcagagtcttattggaagcaaagaaaagaaggcatacaagtaatatttatttatgtgggacacttaaagcttttcagccagagaaaatggaaaatgcattactgtcatatatcacaaagcacatataaaagcaaaatatggtaaagatggtgagctttggttatccagatttattagttttttattgctctgtaatgagttaccacaaacttagtggctttaaaaaaacacccatttatttgctcaggattctgtaggtcagaaatctggcacagtgttggcatgttctctggtcaggatgtcacaatgccaaaatcaaggtgttaaactcaattgccatttggaccctgggatagaatccacttccaagatcattcaggtttttggccaaatttagctccttgtggtcttaggactagggtctctgttttccttgttgactatcagccagtggctgctctcagctcttagaagccatctacatcccatgccacctgccacctggttgccttcatcttcaaactagcaactgtgttttgcatccatctcctgctttgaatctctgacttactagtctgtgagcagacagagaaaaatttagttttaaagagcttgtgtaattacattaggcccaccctatcttaaggtcaactgtgccaaaacttaataatgggagtaaaatccatcatattcagagtcccaggaactaggcagggaatgaacacgagggggtgggaaatctcgagggccatcttagagttctgcctaccacagtggacatctgtcgtgggtcttcctcagcaaaagcagaacaaatgatcactggtgacgtgataaactactgacttctccataaggcatgtgagcctccctctgctctgctctgctgtagtcccttgggatactatatcactctctcgtgctgcccttaagagaagcagtaccaaattggaacatgtttagagataaaaaatgttcttgcaactgtgtatagaaggaaagcctgaagggtctgagggtgtttagtgtgtaggataggggtcatagagacaaaattaattattttattgatttaaaatatttgcagtgttgccacaaagtaaatattcactgtgggtctttaaggtgtacagtaacaatgaataggtgaaggcaacaagaaagaattctagtgagagacatagaaggaattactaggaaaaaaattatggaaaatccctggatatacctagctactttatcagatactttattctttagaatataggtaactagaaattaaagaataaaatgaatttatgatcaaattggtaaaagaaactctaggttaagcaagtaagcagccttttcctcccactgcaggatttctcaaagactttattatggtccgtaattctcagaaggaaagatatggcatgcaaaatgtttcaggttaatagaacatcaaacatattttttatttagacacctttaggactggtattttacaaactttgcttggtaaactgctgtgtgttatggggaatttgtgtatcagagagtggttcaacataaccactgcaatctctttttctatttcaggacacatttgggtacttagctagagctgagtcatctttattaatgtgagctgaatatctacacagcagccacagaaaatgagtggtacctatttgaatgcctatgggacttaactggattatatatattctcacagaaattagttagaaaacggtgctcaaaactttgcctcctcaaagtataagtaactggatgaaagatcacctgagcaaaatcaattgtgaaaaacttgttccagattcaacaaaaattattaacaatagtatattagttcattctcacactgctgataatgacatacatgagactgggtaatttataaagaaaaagaggtttagcggactcacatttccacttggctggggaggcctcacactcagggcagaaggcaagaggcacatctcacatggcctcagggaagtgagagaatgagagccaagcaaaaggggaaaccccttataaaatcctcacatgtcgtgggacttattcactaccacgagaacagtatgggacaaaccacccccatgattcaatcatctcccaccggggtccctcccacaacacaagggaattatgggagctacaatgcaagatgagatttgggtggggacacagcaaaaccatatcaaataatgatggaaattaagaaattattgtgatctgctattctcagtaaataattcagaaaaaatctcaatcttcatgatttgtaaatagttgaaagctagtgcacttaatcagcttgggagctgcatcttggctgttctcataaatctcttgttgaggaagttcattgctataaaaatgttagaggttttccctattgcttctttgaatactaatcattccaccttccttttatataacactttgacgaaacgaagctaggactatcctgatatggtgaaatatttctcatagtagattctctgagcttcattatagagaatgttgcagtccaataaattcagcaggttttgtcattttaaaatttttattaaaaaatctttaagataaaatataactaactcttcttagcctcagtataccaaaaagcagatattagtaggaaaaaaaaaatataagggaataccttccgaaagaatctcacaattcctgagctgaaaaaaagtcttctatattcttaattccagctaagcaggtaaaaaaatctagtactaaagagatagcaaggtgtgactggagcccaggccatctaactcagtccaggtctcttacattaggttttagtttttgtaactttgttctattatctatactcctcattatcttttatgtatgtgcgtgtgagaaatattgtaccataaatatgataaatttattttgtaattatctgtcattatataatcaaatgtcaaatagtcaaatgtccaaggtagacatatttagttataatatcatttctagtagcaaaccttgaaatctctaatcatatgttctccatatctatttctcttcactgatgactgattttttttttactaccgtcaacatcaaaatatatggaaaatccattatttcaaaagagcaatttcagaccaattttcaacagaaaagtactcaaataataggctctaatgttcttacatgaatactgtataaatgtgtccatccctgcagaagttcttatcatatcctgcaaaatagcaaagctatcagttactttcggtaaagaaacaatttccattttactctaggcctgtcttttgggttacatcaatgtctgtaattcacatttctaattttaagttaataaaatttgatattcttcctgttaatcattgtaagcatgggggaggatctgaaaaaacgtgagatggggaagacatgttttaataagaaattcctaaatggaacttgattttttaaaaaagaacttgacacaaataaaatattcttaaaaatagaacatctcaatctgtccaaagacaggtaatatccatgtaaaaattctcatattaacccaccaatgtccttcagcctgtgttgagaagcaccaactctcaggttgggggaatagtttatcctcccaggtccactcaattcttggcctataggctgagattgccacctggggagccaattagtgccaaatatgttggtggttttctgatgtaggaaaatctcccctaagaactggactgagatgagccatcaaatgatagtgactttcagtcactaatgatctggaatttagatagagacttttaattgggttaccaagcaacctgcaaatattttggtgatacctgctgagtcaattgggtagtttgtaacccactcttctctgattatgtaatctttgatatgagtacattacatgttataaatgatcagcatggtttttttttctttgtcattagccaagaaaagacatcactgagtcttttgttcattccttgcattatgtttccatgtgtccaaaagagggtacacagagtaaagagtggttatagggaatagagaataagtattcattaagccatcttcttatgccccagtcttctgctaagtagagttagacctcgtgacatcagaaaaggctacaagcaattgttttgtaaatcttatttccacttaattaacagagctggaatttcatgtctgtttcttagatcattttttaaaacataagaaagtgaaatgtgagtgtattgttatatggttttattttaccagagttttattttcaaataaaactttcaagaaaaataaattctgcctctcgttgtttccagatgcctctgtcagttgctgtggtccagcatattcactttttcctgactgctcctgtcatttccttctgtctttcttgctcagctgcctcacatgggtctcaatcagttccttaaactacaaccttgagttgtcttgcccccgtttggggtgggtattatttttcccagtgctactgttctgcccctctggcttttaggtaacatttcacattggctttcaaccttacacgtcgccagatacacagtgggctcttcagaaatgctgccttttccctttgacatgtgtgtgtggtgtaactttcccactgtagacgaagcagtggccagacctttccttctcccagcttttcttctatagccagcttttcctttctcactcatttgaactctttgctggtaggtattcctatgggaaggtgtgcactgatggtctggctttgtgtttctttgagagctttctcctctccctttgagaacttgtaccacgtgagaaataacatcagtagacctaacttttccattcctagttgtattgcaaatgcaagcagtcgagcaaatgataacaaatcatagtgctgtttcaaaggttgcattcacaggacacttagagctctcgactgcatttcaccaatgaggaaaccgagggcccaacatgttaaaaggctagcaaatgttacataattaatagaaagtgactgggaattaaatcttgtctataactcctaatcacatgttttgtacggtacctcatggtgtctcatttgatcactgtattcctgatccagtttcacttgtcactatgtgttctaaacagaagttaaagtggcagcagattcgacatgttttatatagagagatttcattcataaaatacaaaatgaatgacaatattatcaagaagggaaattgaaataaagagaaaaagtcatgtgaaacatatttagttgtgagttgaagctctaaatgcttatacaagaggaaagaatgtcccatgtcattttatgtatcatatacctgtgaaccactgtcaccctgcacaccaaagtgtcaaaaattaagtgggaaaaaatcatacacctaacaagatgttctttcaaaggattatcctattaggtttggggttggagaaacacctttctgttgtatctcaacttagcactggggcttgggaaggggtctagggaaagcccacctcttccttacaaactttcccaaatgtgagttttatgttgagtcccttataagattatttccaagttccttttgagctgaatgatcagctgggttcccattaagagccttggcaaagagaattcttaaatgtgagcttgccaaagtatgaaatgtgatttctgatagttgtttttcctttttcatttttttcctcctccttactcttctctgaccagcctgaaaagtgatacaaaccaggctgggaactacatgcttgcaacagagtaataccctaattatcatcctcttagtaagggctgcttttgacaggtgtcaattagatttaaatggttggctgtgctgttgggttcctttactttccctttttttctacactgtcattccttgaggtagggttaaatgctgacatccctttgtgcttaaccagagataactatcaaagcaatgtataaattacagctccagttacactgatgcttaggaggctcatccacctctaatgacaagatatccaatcaacctgggctatagttttgtgaacagagttgtgaagtttggttaatgaaatctcacatttcacatggttcctgactgtatttttagatactcttacaagtaggatatcctagttagttattctatctttttatctcttgcatgaataaattacagagttctgcttcttatcaaagaaagcattcactcatcatctgggaaacacaaaacactttttagaccataaattattcctaaagaaaatcttagatgagttgggtactccttgttgtgtatgtatatgtgtttgtgagagagaaagaatgtctgcttgatggcattcattctaaatgatcatagacagactacccgattgtcatcttacctgtcagtccttaaagcaaactaccctagaatgcaaacaagcaagccaccaccaaaaatatcctttccaactccttgaccaaccactgtgaatgaccgaatacacccagttcctcctatggcattttcttccggcttactggcagagaatgtgatttcgtggtagactggtagacggttggaaaatgaccccttataatgatggaatttacataaataaatgctgatagcacaaaacagataatatgctgtgggtatcatcacaataagttgtctcccactgacacagagtctaagttggaagcacacaattatgcaaatcaaactaatgccagttgctcattactgtcatggtggtaaaggcaaaaacatatcctccatagacagctcgagacggggccacaagccaaaatgtttggttttgctgacacagtaactgagtcaacaaaaataggatataatagtaatacatcaggggaacccacatcagggtagacctgaagcttaatggactgtgaatcctatgtctgtgcagagcaccctttcactggtattgacccataatacgtctgcttccacatttgccgattatgtagaaatagattacagaagcaaatttttttaagacctgaaatgtctgcaagatattctattagcttttcctaaaacagatgatatgacatttgtaaatacttaaataatgtcacatatcccaggctaaaacacttcccagaatatttcaaagtacctgctgctgtttgatctaggtttgtcctgagttctcattatggcactgaagatgttttcaaacaatagaatgctcatttgccacataaacatctttcctatctttaaaaaaaaatagaagagctgtcaccaggagaatatttaaccctgaatatttcacagaaccttgaaaaaaaatttggccctattgtaggttagtgaagcaacaggtgctgacccaccaatttaatccatttctcttctgaatgacagggtaacatgtggtggattgatgttataaatggccctgatgcttcacccttcatgatattcatgccctttgccacaagattttgctgctcttctcatcaagaagtatctttccttgccccttggctttgagtctagtcatgtgacttgtcttggccaatgggatggaagcaattttgccagaagcaaacgcatagaaaagcatctgcacactgccaagtcagcttatgctataaggacactgtctaggaagaacatgcttggccttgcttgctggagggcaggagacacatggaagagagctaagttgtcctactaaggccggcctaggccagccaacaatgagccagcccctggacagctgagtgagctcaagtcagaaccaactaaatgagtccagcctacatcatccacagattcaggaactaataaatgctgaatgctttaagcccttgagttgtatactgtttgttaagcagcattattgtgttaacagacaactggagagttttcacaaagttttacaatatcaaaaaaatacaagaaaaatataccctataaataatgcaagaaaagattatttagtcaccagatttaaaatacaaacacgggaaaaatggaaattaaatcacaatgagacaccacttcacacctgccagggagaactataatcaaagatagacaataacaaatgtttgcaaggatatgaagaaattggagcctttgtatgttgctgttgggaatataaaatggtgcagccactttggaaaactgtcaaacagttcctcaaaatgttaaacatagcaatactcctccttggtatttacccaagagaaaggaaaacctaggtccatgcaaaaacttgcacaaatgttcatgagagcattacacaaatggccaaaaaggaaacaattcaaatacggatccacagatgaatgaataaacaaaatttggtatatccatacaataaaatattactcagcaagaaaaaggaatgaagtactgatatatgtgatgatatatgagtcttgaaaacattatgctgaataaaagtagccagtcaccaaagcccatgtattgcctgactctatttatacaaaatgccccaaacaggcaattctatacataaagaagacagattgatcattgcagatgtggagggcatgggaattaactgccaaagagtacaaggggtttcttttcaggtaataaaaatgtaaacgtagatcacagtgatcacggtgatggttacacagctctgtgttatgctaaaactcatttaattgtcaataggtgatttttatactatgggaattatatctcagtgaagctggtaaaaattacataaacacttcagcctcatcttctgaccaaaacatggcttgtttcttgttttaggctctcttatatctaccttcttgattggaagctttaaagtgaaaacagaacaaatcaaaagtcttagtattgcttctttagaatcacacacgtatttgctgtatttgacacatttgaaaagtgaaataatgaagaatttttgatgttctataatagacactgatttttcacagaactccagctctgtctttcattttcatgttttctgtgatactcatgctcggcttgctcttaaaactcacctgtgaaaaagaaagggcactacttgccacatcttaggtttgcatatcaaggccaacttcagtgtgtaaacgacacttgcaccaggcatgcttggagctgttcccaatttcgtgttcacagcctctcctccagcagcaggtttgaggtttaacttgcccagttgtgagaactgagtaaatagacagcccgcagtgctgtcatctaagttacctcttctggaacccccactcactgctcccgccacagcttttcttcagctcttcatgatttttgcctaaattaccacattttctggactagctcacttgcttctggtttcactcccctcgagtccactctcctaattgcccccagagtgatggttgtgaagtgggtatcctggccatttcatacccttacaaaaaacaattctagtggcttccaatccatacagataaaagaaaaaatttcatagtataacttggaaggcctttcataatccgacagccgcgggaaatcttgccactccctccccttggagctaataaacatttgctgttctctctcgtgccttcaaataagtgctcccttgtctttatgtgtggtagaggagaagaaattaaaattacaaataaattaaatatattgggagagacagaaatggggagttgctgctcaacaggtataaagtttcattcattcaagatgaaaatgttctagaaatctgtacaacattgaacttagcgttaacaatactgtactgcacacttaaaaaatttaagagggtgtatctcatgttatatatttgttacaatagaatagatgaatttataaatatttatatagatttggatatagctttactgacctctcttcacttgataagccccctcatcctcttgcagtccttttagcaccaactctgccaggaggcctttctaaatctgagatttgtgtcctctcgtattttaagctactggatcagaaactacctgtcctaaacccacctgagcaaagcaccctcgtccatgttgccagcagtgctctatgtacacatgtacacatcacacagcattatcattcctgggttttatttttctgtaaactttttgcatagccaattgttgccagtccatataatgtctttcttttattactgtaattcattttaattagttaattcctgcatcctcattttttcctgccattactctctccctatagccacctgctgtatagcattctttggattcataaacatgtatggattcttgattgtggataagactgtgaaaatgtctgcgtattttacacataattgctattcacctgtctctctgctgctgaattggaagctacttgaggaagggaaaccagccttttcccaacctgaacaccttgcacagtgtctgattcccagtaagagctcaataaatgagtgtcaaatccatgcatgacatgatacattaatgaattaaaagccctacattttagtttaatttctaataatcttggtgggctttacaagttttatctctcttgctacaaatctaaccatgagaacttgcaataagcgctaaaaatcttaaaatatgagaccatttgaatctcagcctcttttgctgcccatgtcttccttctctggcatgtccctgaagcactctgtcccaactgatactagtagatattttagaccatctagtggacagtagcttaaatgtttgacagatttctacttctttctcaaaatggttgctgattaatagctgaaaggatcaaccccagagggaacctgaggtttcctacctgcccaaagccagctttcacattcccatttcccaccagaggactgcaaagatttttcccttgactttgaaataacacttggttttacagtctgcttgcctgtggtttaggaaccgagcatgtcagcactcctttttactgcctcagtgcagcagcaaatgtgttctgttctctcctttcaaaagtgaagattgtattttaaaatcactcttgcccctagggagccactcactcctaactccctgacaggccatgaggacctcaaaattaagaaagatgtccagaaatgtgagtttgtacagaaaggactagaaaaccacccagacatgtaacagctcggttacgtgcctggcttctgtcaggagaaatgtgtgtctgaattttcaggctcataatagacatgtacagctaaccgacttttattttgcctctgtcatattgatctatcagtgaatctataatagaagatgggagcttggaaaagtaaaaagtaataaccattgagatggatagcctgagcagaaatgtagtttcatggggacacttagtgcaaagaactgtagattcatgtcaagggggcacaagtatccccttcaaagccaactgttaaaaacacctagtgcacagatgacctgccttcagaatatgatatgtttctgtattgattttcagagtttcagaacaacaggaaatagccaaatgaaagtttctttgcagagcactaaaagtaatttaccttctgcctttgatttcagcttcagattttgttttatggtgcaaagtacaagtgcttattttaaaaaattcatttctaacttatggtggaaagcagcaccagagaccaaggaagtgtggagcaagaaatgagccatgaaatgaaacaaagcaaaaccccccaaattgcatcaatggagttagtggtaagtcattacacaatgaagtttgtcttttaagcacaggcccactgattggcaggcaggattttaccattatcagaatgaggagcctataaaatgcccaaaactgtggctttgaagtcatctatatttagcttctgtaattccatcttttgtacatccctttgcatgaaaaataaagtgtcatattcaaataaaattggccttccaggacagaagaaaacacagtttactttccagtacaagttggtaccatttgcacatgtttggtctacaataagtactaagcatggggcaatactaataatttgtgagtcttgactagacctctttttttaaagagattattcactttatattcaaataaatttggtttatacagtatatgatgatgcaaggaaacaagtttcagcttattcaatgcccaaacttgaaatttatttgtttccattgttttcttcatttggggctttaagaagttgcattaagcagagttctggcaagaaacagaactcaaaagaagcaattaaagagtttcaacagaggcacaaagcatgggcagggttaagggaattcaaccaaggagggtgaaacaagcattcctgaggctcccaaccaccaccacgtctgaagtgaagagagaagggaatgtttaaagagtccatgcagcctgagtctgaagggaaggccacccaacaggagctggggccgatggaagaggagctcagacactgccaatccatgaaccgagggaacaaacaccccgacttttctttcttcatgtcttctagcttcctaccaggggctcctattgggtgaaccccactgaaaaccagataaaaaaagcttagtttcacagtctattcatatcagcctgctgaaacatacagccaagggagaaagccccagagtgatccagaagggcacattaaaaaaaacaaacaaaaacgaaacaaaacaaaacattgtatcataagagtattttattctagatatgtgctctatactcatagaactggcaatataattgcaattcttcaacttcagcagaaaaacaaaaatgcagctttttgctgcacatatgacataccctgaccaagttaagagagagattcggctttgggaagaacaaggatgaagtaagagtatctataagtgggagaaactgttaagatcttccgaaatagaagttaaacgaaattaaacaaagcagaacaaaagcaatggatatctgttaacctttgccttccacttcttagcaaataaaacattacagcaagcataaatactgtgaaaatactcccaggagccatgggaataactaacctcttcctcactctctgctcaaaaaactctcctaatcagactattggaatatgccccctagttagtaagaaaaacaacaggaaactgggatttgctttaaagacatttaatcatagactatattttaaaatgtgcattatatccacaaaaagagtgatatcagtatcatatgtttgtcaaaacaaggttaaaatgtatatgaacttttgacttttccctgtccaaatcacacccttgtaaggagcccattttattgtaaacatttaaatctgttaggtattagatatgagctcagttatttttgttttgtgtatttttttattcacagatgtttttattatgctttctgcaatcaaatgatctgggttagaattagaggattagaatgccattggatcttactttaaaaatacaaatttatctattttcattaggaacctgacattcttatccagaaaatttacattccatactgaatccaggtattatgtaacacatattggttgtatttttttaaaaaaagtaacaactacttccctacatagataaaatatctatccattatccacctatctatgaatctaaatttacaatgaatcaagtgccaaaaatagcctagcctacttacagagttctctctacaattgccagtcactggaaaaatattcacaatcctttaagtccattaggatggttggttctcacttcagataaaatgataactatgttctgcccaaatttgctttgctttcattctttgcttgcactctcaacaaaaacaactttttaaagcttgaatatttcatgaacagttttgaatggcttcaattgttctgtatttttaaagtgcagataactgtaggaaaaatatatagctaaagatgtctctcgaagtatgttgacactccaatttcattagaacaggattaaaatgtatatttacatgttgtgtgtaaagaaaataccagctttacagtggtaagtatatatgtgaaggactcatttcagcatatgactatacatacacccacatacacatgcatagacataaacacagacacacatatgcacacatataaacatacacttacacacataaatgcacatatacatacatacatacacatacatatacatagatatatacacatacacctatatacatactcatacatagccagccataaacacatacataatacaagtacacaaacacacatatacacacatacacataggcatacacacatatatacacacatacatacacacatatcacatgcatacagataaacacatgcacacatacacaaacacatacaaatgaacacatatacatacggacatacacacatatacacatacacatacatatacacacacacatccacatccatactcatgctgacctgggataggactgtgaagaaaaaagataggatttgaaatcagaaagttggcattcaaacctgattccacctcttcttaattataatcttaaacctacactaccttttaccctatcaattacttctctagcaactcccctgaaccctgtgctctcatccataacttatatatttgtaattccctgaactctctgtataggcatctgccatcactcatttgcttcctaagtaccattgccttaagttcgctcatcacttgattttgttaacttgtctcttgtttcaagtctcagctaacttgtcaccttctctaggttcccctcttgaatttctccaaactgagtcagatgactgcctcactcttactctcctgtggccactgtacatatctcctatatcacagtgctatcccattgtcttttgaatttctgttaccttgcatgtcttctccactggatcaaaattctttggaggacagcaccttttttgtctactttcatattttcagtaccttatatggcacatagttagaatttcaatgagagttttatgaataaatgaatcttgaactcactgaatttaacttttgactcccagcctcaccaaatctttaggtactatcctttcataaagaaatgagggaacataaaattccaagtgtttcagaaacatgctaaagtaaacaacagaaagagtggagcagaagttaaacccaaggctgtcttacttcaaagactgtactgtgtcatgttccctttccaggtagttctccaaacctctgtttatcagagaaatggggctaagaaaactgcccaccctacaaggctgataaaaagaaccagagaaatcatgttagttaataatttggaacagagttacagaaaagtctaacttttttattttacttttacagaggaaatatctgtaaatagcacagagaataagtgaatccgaagagatttcctggacacgtttccttaccccaacttacaccaaaggttctctttaccaagctctatctggccaccttagtttccccctagcatgtgtgctaagcacagatgcactcctagagtttatataaaccagcactgacaaggaaagtatagaaccagaatgaagagtatgaggctcaggaaggctgctcattctatttgtctgcaaaatgccatcagtttgcagtttaaagagagaacaacataagtagagcaaagttcaattgctctccaattagccctaattaacgaattgaaagctgtttgtatataaccaaagataccttttgttttgttgttgtggttcagcaattgagatgagtagtccaagtgattagtaactaccagagaagaaggcaatttggggacaagtacatgcaattttagtactgttttatggggtaaataatgagtttagaaatgttttcactattttaataagaaaaaagaattttaacaaacatggattatttgtagctatccaaaggcaataaaatccaaggcaatctatggaaattagtcccccatttttgcaagacaaacgtgtgaatcaattgtattttccaatgctctgttgagaggaggtatctcagaaacgcaaaatgcattacttcatattagcaatgccattcctactgacaatgtaactttcagtggctctaactcgagtccaaacacacgttttccacaagagtcccatgggaacttgcaatcaccttttcatacccctaagttggtgcagatcaggagcaagcccccctggatgctaaagcaggagatccttctctctccttcttccccaactgtcgtgtctataacttacaaaatcaaaatggagtttttagaaacaggatgcttggactgaagacaggaacgtgggatggggccctgacaggagcaggaatcacatgcaactggaggggtcatcaatgagggccaggagctgtgtgcttcctttcacactgtctatccatcagtaattttcacctggtgctcagtcattttctatctattataaccaaattcccagccagctcagaatgggctggccttgaatatccctgtctttactgaattctttctttcttaactgacgctttgtggttgaacagatgcatcccagatgtgcaaaaaatagttcacattcacagagaataaagtcctggctcattaaagggaagacaacattccgtcctggcttagaataccaagatagcatttcccagagttgacagcgaattggaaaatttaacaaaagccatagaaatacttcctgggtcaccaagaaagtcataacaagagaataccattgatatgccacccagttccaagggcttcccttggcacttagcctcctagccatttcacacatactcacctttcctgactcctagttagacctcgtgttggtacccatatacctttttttctggttcagaaaggctggccccgaaaagcagtagcaaagctctagctctgcgtggtggcaggtgcctgtagtcccagctactcaggaggctgaggcaggagaatcgcttgaacctgggaggcggaggttgcagtgagccgagatcgtgccactgcactccagcctgggtgacagagcaagactccatctcaaaaataaataaataaataataaaaagataaaaaaggaggaaggtgaaatgggtgcatgcctatccttcactaggaaagcgattatagtggtctgggaaaacagaatgatgctgaagttacttgagaaaggaagtaccaccatttgctgtggccgtaatcaagtctgtaaaggctgcaaagggtctgagcatgttcctccaattatcaaaaacccattcacaactcaggaactctcaagaggttcctcccttctctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagttgactaaagaagatagaatgaaaaggaaccattgcacaaagatatgtttttatttgaccaacaggctttattttgattccccaatcttctggaactcagactttctcagcaaacaattgcactgcccactgagagtaaacagcaaacctgccaatatcacaatataccctgagatgaacacgtgtgagggaaagacttcatatgccagacataatcctgatggttcccaaatacacactggttcccagataaagtctggtgactggctaatgcttttcactgtgattaaaagcaaatactttaaaaaatatttaatgattcattattatatttttctgagtgcttaagtctattgtctcattattgtttgtttattcgtagtttgggaaaattttgttgggacaaggtaacaagatagatctcagctacagccagaagtcataatgttcagacacacattaattctgtggacaatatgagaaaatgggagcaacaattaccctataattagggttgtgaactggggaagggcaatgtccaatatcacagagggagggttgaaagaaactagagatttgacagaaagtgatcaagctcacaaacgtatctatcattgcctcattttttaatgttttaggtgaatgaatttgagtttctgtgttgagcaatgacttgaatatttcatctcactcatgtagcccttgtcacaaattatttttcctactttagaatctactggactgctataaaataaaactctaatgcttggaacaacaataacagaaaccaaaattttatgctttgttcttttacaggccccttcaaaccccaggaacaggtgctttaaattaggctgccgaaggccagtggggcctggctttattatactttggtaaataatagtcactgttgtcatcagagttctctacacttccagaaaatgtcactagccacatgtcagcagggttctttgtctaatttctacagctaaggtggcaagaaggttattagaagtaatagcaaatttaaagttttattagcagtaaactgcaaaagctaatggtgatgccaacactagataaaatcattgtcacagttaattctgaactccttatttcaagcttaataataggaaactcaatggaaaggatattacacgccccatatcactcatgagtgcctcaggcctgagtaacttgttattttgctcatgagtgaaataaaatgcagattatactgcctgctatcaggggcattgttttaattgagggtgaatgcatggtgatgaggggggctccgagtaggttctcatttttgtaaatgttatgagaatattcttctcatttgtaactgtgactcagcacatcacctttctattacttgtgggggtgtgtgtgtgcttttagagttacctttgtttcagctccagagaaatgaaagcagctggggagatgggagggtagcatttggtgcttctcaccagcatttctgcaaaagtgcctctccagcattctagcgcctttgtcttcaatccctcagtctacagaggcaaacaatggaatatctgtgttgctctgtttgtctcattccaatcctgtatgccagcacacacacacacacacacacacacacacacacacacacacacacacaaagcccttccactctgatatacactcccggccaggaataaataatacaagatgcactcctctgtgctttacatttactaagaaaataggtgtttccgagaatcaagatcacgtgggattttgtgttctttttctaaagtatgttgctctttttttcaaacaagttgaagtgatttctgatcctatgccacaaatcatccaaatgggctgccttgagagccacgcatgcattcctgctttaaggggagccttccattcacttgacacggactgtctgtaattatgcagggctaacttcaggctgcagtgtgcgtggagacgactattttgaagcaggtcctattccctttgattgaagttgaaatcctaagacttccacagccgagatcatttgtgcctctctgagtttcaatattccctttgaaatatttgtctgatgatacaccgtatggacagagcctcctacagttcagtttctgagcaattatcactccatggcaatttgacttcatgtagcagtggagaaataaaatacttaaggctgctgccagcctgcctaacaaagcttttgcataagttaaagactcagaaaggggtgggaaacagtagttaaacctttgctttatcttttaagtttgtaaaacatataaaatctgagttcaaaatcttagaggttgtgacagacttctccattagcaggtgaaattagcccccaaattataatcttgattgattcaataatgttcaactagtagtggaatgagttttattttgaataatttcctcactcctgtttctctgcatcctatttcagtttgcagtctgtcctttaaatggcatttcctttttgccaaagcaccaagctgtgaatttattgagaaatgggtgtgtttacaataagactatgccattaccaataagtcccattcatatcagaaaaaattaaacattatattcctaaattgtaaacaaacagtcctaaattccagagattattattcccagaaaggcaaagtacagagccaagagaatttgtaaatatgtacaactttacaagattgatatggacaccgatgcatgttgcgctcatctccacttatttcttattcatacacatcattcttatgtttgacaatgaatatggtattgtggcacttgaaatcctttttttattaaaaaacagaaagaatgtcagccagttaaacatgatattaggatttcatcttatttttttgttttgttttgcagcaagagaatttaaaagaaccatcaatcctctctaaaaggtacttttaataaattggcatacctaattttgcatggatgccatgatgtctggcctgcttctatttggagtctcttgggatctatacagatttttaatagtcatgagaacttgtcttgtactgtggattgtagaattgtcttctattatagtcagctatccactctatttaagacagaagtttcttttgctgctttcttggagttgtttgatggtttatgaatacataaaaatctgttggtaattataggttaacgtaattagcaaacattttaaacttaatgttttcctaggaacagtttttgtcactttttcatgattgtttaaatattatatctttaaactctgtaataatttcatctaagcaaaagccttgatctttaaatcatttgatgaaccttaactatccatgatttgtttcaaaactaagtccacacggagacttcactatgccatgtgcctcatctagttattaaatgtgtgatacgcgtgcttcttaatgtgtgcatattagctatttttaaattataattttaccatgaagaaatgaataaaacttccaaaaatgtctgtctcagtggaatgtacactatcgtagggagatacgtatatatatagtatattggttggtgataagtgtcatggagaaaaatcaggcagaaaagataatgtttagggagagcctctctgaaaagatgacatttgcacaaaaggccccaaaggaagtaaggaagcaagccatgcagctagggatgccatgcagctagccatgttctaggcagagggaaaagcaattgtcaaagcattgagacaggggcctccctggaacatgtgaagagtatcagggaagccaatgtggcagaggcagtgggagtaagaaaaagagaactgcagtggatgagatcagagaaatggtgatggtagagaatgtgtgtgtgttgggggggcatccattgagtggcttctactctgagtcagatgaacagctttcaaaggatccttagcagataagtgatgtgatctgccttatgacttagaaaagaaaacctgagctaccctgagaatagaccctcgagagaaaaagggaaggaaatagacgagttaagaagctgttgaaataatgcagatgagagatgaggaaggtttgtattatcagtagagatgggatggagaagttacattctggatatatttagaagctggggtagataggatttgccaacaaattggattaaaaatgtgaaagaatgaaagtcaaggataattccaagtttttaatctgagcaaatggaaggtcagaattgccatttattaaatggagaaaagtttgggagaagcagatttggtggaggcaagtggataaaggtttgaacatttaaggatggggttgagtaagcaattgcatctagaagtctctatgtcagggagacagcttttgcttcaagattttgaggccatgagaagaagagaagaagtccaaaggctgagttcttagacactcattgtttagagttcagggagataaggagaacccagcaagcaagactaagaagaaatgatccgtgaggaaggactggattcaggagagtgctatgtctcagaagccaagtgaagaattaaagaaatgaagcatgacagtaaaacttatacatttatttctaaataaaaataatctattcatcaaaatagcacgacatttaatgtgtcgataaatatatttaaatttaaacaaacaaattctactttgaaatctaaattgagtagtataattgttgattaaaacactcaagagattatattcaaatccctactttatttattttacagtgccatgaacattcaaaagtttgacccaattctcttgagattccaaaaattattttcaaattcttttggtctttttatagtgtaatatgtatgaaatatcatgtttgctctggggtacagtattgtttttaatgctgggcactgtaaaaattctcaaattttagaattcctaagtatctgctttttgtttgttcttggtttatattttctgatgtcaaaggtctcatatttgcatgcctattctaggcatggattgtgggagtctgagctttaaaatagtccacaagaatcattttgtgatttgggctttatctactgcctttaattttaggcatcaattttgaagtcatatcagtagccttaccacttgaagtaccaccaagtaggaggctaattttatctaagaaaagtgtttctacttcctttgtttttgattttggtgaagacatagaggggataggaggataaagtagaaagaagtgatttggcaactatcctattagtttaaatcataattagacctaactgcataattcagaacccaagttgagtctcctagcagctcccttaggggctctggggctgtcccatcacagaagccctccactgaacttcctccccagttgctcccatgggcacgttgccttgtgtcagaagtcagagtatgtcttcttccagcttgagtttctagcttctaaatatttgtagcagactttaagtggcaggataagtggataaatgaggaatatatcacagagactcacaaaactgctcaggcccaactagtgcctatgttatcagctcctccaatctctgtacttttcctttgctagagacatcacacccacaactgcttttcaatgcccttgccacaaggctctgagttccatggggacccatgtcttatacattgttatattcctggtatctgacaccatatcaggcatactaagatacttttaaaataaagcatgagaggcccaaactaccttgtttaaaaaggcagaaaaaaattgtaaagaaggatgacaaggcgtgaatatttttcaagtcacaatcataaaaatttttataaattgttattgatatatagattatatataatctatttatattagattaaatataatctggcaaataaattaatgaatggatctcatatagtttattttaagtagaattcatagtactgaggagaagtaaaatcaccagatacaaaattaacagatgttttagtagcccaaagtgtggagtaggaagtatacgttagtccattctcacactgctataaagatactacccgatactgggtaacttataaaggaaaaaggtttaattgactcgcagttccacatggctgggaaggcctcagttaacttacaatcatgatggaaggtgagggggaagcaaacttgaacttttcacatggcagcaggagagagtgctagcaagagcagggaaaactgccttataaaaccatcagatcttgtgggaacttactcactatcacgagaacagcacgggggaaactctccctcttaatccaaccacttcccaccagggctctccctacaacaatgagggattacaattcaagatgagatttgggtggggacacaaagcctaaccatttaagacatcttagaattctacctacctcagtaatcttgagagacaaatatctgttattttcacctttgaggaaactaagatttcaaagatttagctgacttgcccaaggacgtctacctgagaaatgtttcttactaggaatgtccccaggagatattcggcaatgtttggaaacatttttggttgtcacaaatgggaagaagctggaaaacttttagctggcccaggttaaaattctattagcatgtaagaagaaaagaagatatcaaaaaagaaggagagaacatatcaaagttgcttcataattaatataaagtcagatgctccaggagatgtcaaataatttgcccatgatctgatgatggtcaacttactcaccattaccttgttctttccagtaatgataactcacacttttcttcatagcctaaatgaaaaagaataacataaagcaagactcaacaaactaagggtcttcttgatactaataataaattagaagttcaagttccctatgagattaacaggctcctttagagaaagcacattattaagtacatgtccttctaagtgatcaagatgtaagttttccttgcagtataatgcttttaggcggagaggtaacagactccagagaccggagggagacacaggatgagaaagggaggcaactgttatgatgtgctatacacaaatgtgtgacagtctcaccccatgaaggctcacagctctccagttccttttgatgactgcctgtgtggccaaagtttaaaatagacttagtataagtgagtgctgtgccacaggaggagatggaagaggatgagaaaattacaaagtacaatgtagacagcttagctaggaagatgatgttgacatagatgatagatcaatcgatagatagatagatataaaaatggaaaacaggccctttcctcttaggcactacattctctgggacctttttcaagaccatgtgaggtcagcattactagccccattaacaaatgagagacaaagaatgctaaatatcctgatgtaggcagcaaagcccctacctattccatctggcccagttgcctctataggcttactttgtatcactctctttctcattcattcagctccagccacactggccaccctgctgctcctcaaatgtaccaggcacatttccatggggcctttacactaacagcttcatctgcctgtggtgctcttccctgaagatctacagggttcattgtttttctttaggtgtcttcaaatgtcaccagttcctctctccctcttgatattcctctactccattccctgctttacttctctttaaaacatttctcaccatcatattctacatcacccatctattccaatcctgcccccaacaacaaaataacctgatgtaagagcttgcatgtaggcagtgtattttgcaagtaatgccaaggaacaaaaatgggaaaatgggaagagtgaaaagagaacaaaagcaaagctaatctagcagtgcattatcaagttggtgacaaatgtgggtaactagggctcaatatgattaggggtcctctgaaagtcctgcataacacatgtcagaattgtctaccagagttacaggcttctatctcctattctttaagggtaatcccatggctgtgttaggaaagattcagaatggctgagcgggttcccataagtgttccacacagaggaacgctagggcaaaagttggagtgaggtgttagctggtcacacctgcaatcagctagttgtggtaccaatgtctggaataaaatggtcaaccaagaggttgtgaggtaggatataagaggttcatgaaagagtccagcttttgcaacactgagacttctcccagagccttcaaggcagtgtggccagtactgatttctacaatagactcgataaagaaaagctatttgggaaagggagtccctgctaccaccaggccgtcactgatattaaccatcttttttcctcctccaatgtcattctaagttttccctattcttagtcaccactccagttggtctaaactgctttgtctggagagatggctcaaaccatcatctacatggggttagaaacctttattactacaccacagtcaggtcattgtctttacaatagtccgttttctgttatcatctggacagccccaaggaagctcctggtttctacacctgctcttccatggtaccaccaagcagcaccaccacgaggagcaaccatagctcctcattcaaatcaggctcagttatccccaccaacgtgatgacttccttctgcttttggggccacttgcatgagaagcccaaaatggccaacaatggtcatagttccaagactatgacttattctgtcctctagtgaagtatcctcctgccatggtagaaatcagaactcctaatccatcagagcctagattgtaggaaggagaagcacagacatcactagtaagtatgagtgataaccatggggccaatcttttacttcatggtttctaacccatgtattctagctttggggaggtcacagcaccatatgttggccattaatttggggcatacacacttcctgaggaaagcattccaagcctacatagtgtagtccctaaactggcacctcggccaagcccccaatatatcttcccatcattctttgaggaagccacaccactgtaggtaagacccagtacttttcaccattgtattccaacatgtagattagtacctggcacgttcatcactctgaatatatgaatgaattaatcaaccaattattctctttagattaactgagacattcaaaatcaaaaaacaaagaggttgaaattcattataaactcgtacctcacattattaaagcttgaggaatgatctcttagatacaaacgtaattagcttctatgatgttgaaaaataaaattaggaaaattgaaaaattcacactttcgtaatgtatgtggaattaatctattaatataaaaaccatacttatttggcataccaacaaatcatacacttggcaacataggggtacaaattcacttatttttctttgtcctgaacactaatgaatttcgtgtatgaaaaacttcattaagaaacattgtttaaaaacaaattgtcaaaacccgactctaccagattaaatgtatgttaaaacatttaagatgacatttattgcatcaattttttaaataatgcttgagaaagctgtgaacataacttcatagcccaaaaccttcttctctttccctttgtagcatatttctccgataatgtattttgcctactgctaccaaagtaccagaaaataatgcctaaaagaccaaaatgaagtgtttcagaattaaggagaaagttgtaaatttgtaatgttttagacacatttcagtttagcgcttgatagatcatgtcgggttggttgcgagagggatttcaagggcttgggaaaataaagtcagtgtatgtgtagtttcatttttgagagaatcactttattactgatcacaggacagttgttgagctctgacagctctaagtgctgaaaacattagagaaggtccatttttttgtttttgcccaattatgaactgtaacttggtgagagaagcaatagaatctatttacctaacctaatggtaatgcttcattttaactaaaatgtcaacacatagtggtctctgcacgtatttcaccagcatctaaattccaccatggggttcaaattttttaaatgaaatcttagacccttggtagaaaaagagccaaggatttatatatcaatgtaaaaatggcctatcttaaaatatacttatcacaaatataagaaattcctaaaatttggggttttcttctatggctttctcaaaggtcagaatgcaatgtttctattcaaatgaacaattcaactagttaactaatacgaagccccttttcttatcttctgctaacctctcacctttgaaatcagttgtctaacttcaagtgttgccttcccaattaatgaagttatctacacaattttcaaaatgtgactccatgtctatgagtttgttgttaatattactggaaagacaatataatgtgaaacaatagcaaaaagcaaaaattgaaggcactagcaccttctttgtgggacaggaaaactaacaaaacttggtgatttgtattaactcaggaccacagtaatctcataaaatggctctttcttggattttgcaagatggtttcattatttagtgcaccaatcaaaaagatagccaagtttttaatccaggccaattgaaagcaaacaatcaatgcaattaagaaactaggaaaaaaaggagaaattctgatgtccagcacatatattaaacttaattatatttttcatgataaagtaaatttgctcagtggagtctcaaagtatgttattgttataaattattttaaagttttcaaagataactttcaaaattaaagttataaaagatgactcccattttctcattttcctcctcagtttttaatgagcatacatttctcacttcatccattaagaaatgtttgtggtttaaaagttcatgttgactgcaaaaatggtgatagaagaaagctctgaggatattgctataaagttaataaatcatcttcactcatcaactatcttcaacccgcacaagttataaaggattattttgttagcaccacagggtacacaatttaaatttagagaatcagccctagcagaataagtttgaattctggaagcttctaggtccccttgcctttaaacattatacgcttcagagtccttacattttcaattgacagagaaacagaaaatcattctaacgtttaccgtagcttttccctctaagggcttcttgcaaagaatttgcatgttgcaattatacctcaaattagagatttgagtttccctgcctggtcaattataagacccttggccttaccagagaatgaatacacgctctcaactttgcaaaggtctgagtcaacagcttgttgggctttgaagaacctcagccgtttttgcggctggagctttttctccttttcgtgtttcaggaccactgctggttttcattcatcttcattcagtgggtttcatgtgacattttggggctggaaacataatgtgtcagaagatagctgcagcttcctactgcgttattgtttcctttgtcagaaggtgagtgagcacaaacattttccaattgctctgattttcagacaggtttagatctactgagccatcactgatgcacacgcctataccatttagaaacacttgatatagatttcagaagagatttctaagttcagttctatacaaataaatgtactatcatttatcctttttccagaagaggcagagatttcatatcctctccttggtttaccccgatcagtataaaaggaatagatacggtgcttcaaaaacacttctcatttgggttcaaaaacagcagctcacctttctgctggaagcaaaacattatcatgatcaacagaatctgtctgttgggattcagttctgcaatcctttcatggatcaaattcccatcagaatcagaattaagtcctaagtgaaaacttaaattacattataatactcagcctcataagttccaccaaggctttgccaaaggcattgaatgatttatgataaacttcagaacctcagtcccctcttcccagggtgtcttcaattaattctttgaagaactttactcttgattccttgttgaactgaagtaataaggggtttaaggcctttatatttttcctcgaactttctcttcttaacttagaatatctgcaagtgaaatataattgattggatctttctaaatctgtcttttataaaattatggttaaatattatcttattcctgcagaatttatatgacttttaagtataaatctctatgtcatcttagttataaaaatcatatcattagaaattgccaaaatgcattacacttcagcctgaagagtaaggttcctttcagttagaaaatagctccccaggaaattccatgttggtctgtatttgattccccagccgcttgggatgcaaatgcatgccattgactgtaataagaattggatgtatgtctataggtagactgtaaaattttaaagtttgatttgtctcctcatatggagaaactgaatcctaggaaaatttagagacatttcctagatcacacatttcattaaggttagtgtgggttctctttctattatggggtgtggcatcagaaaaatgtggttttaaacactgggtcaactagtaatatgccttatataagtcatggcatagtctacttagtgatgccatgaataacccactgagcttcatattcttaactagcatattcttaacttatctatattctaagatagctgagaagatgaaaaaatatgtatataaaaattctggccccaacacgcattaaatgatggtaaagattataattgttgatctttttatgtaactaacctcctaaaattatctttctgcccttttctccctgattcattcttcacacagcttatggattaactatctatagcacaggtcttagtatgattctctttactttaaatattctcaatggcttcctatcatcaatgaaattatcttaaaatttctcaccctaaattgcaaagccctgcgtatcaggctgcagcccacctttccaaaaatcattttaactgtttttctgtaattacactattttcatgtctagctaaattggtttacattccacagacaattctccaaatttctaaaaccaaaattccatctcccctataagcgctttatttattcttccaaccagatgcaacatttcccacagaagtggggaagagaaaggaaaaagcacctactgaatatattttctgtgcagagttctttcttctgtgctgggcactttaaatttgttatttcattagtgcttctcttatgacatgttatcttttgttataacaaaagacatgtttgttgttgtccattaaagctgtccattaagggcagaaataatgtcttaatctctagcatagaatatttacaagtagaaggacttagggggaaaatgcaaactgaacaccttaaattattatcaataaaagcactagccagaatgaggagttgaggggcatttgaagcaacttggaaaaccatggcagcttatttggggtagaaaggccctcttttatccatcataaatcatcatcagatttatactttgttagcaaaagggggctgaagtacaacatgtcatatagtgtgttgcaattgtaacagggcctcactcttctttcttcttcccaaggcctaatcagttacataaaaaaagaaagaagagaggagacgagagaagaaaagagaagacaagagaagagaagagaagagaagagaagagaagagaaaagaaaggaaaagaaaagaaaacaaaagaaaggaaattaccacgaaaccagtcctggaaaatgtaaaatgttacttgcatcatcatgtgaaaaagctcaaaagatggaaaaatattttctaagtacatttatttggacataacataagtatcttccaacatattttagcgatggaagatgtggtgaattgaaaagatgagttcagctctacatatgctttatggtcacaagttgccacttttaaaacatttatatactcttatgcatatcatataactgaacatgaatgttagcatctaagtatatgtatctgatgaaaatgccagagttataaaatcttttttatgtttttttaatcacaaaaatatcaaaatgcaccttggttttagggaataattttctatcactggtcctgagaacctctaaaattatggaacaatcgttccagactctcaataccattaagttcaatgaactataaactccagggcaaagaacacagcttttttgatcaacaatgtatatttaacgtccaagcttaatgactgaagaaagtaaactccctaaaaacataagtttttttttaatgaatcaaaagaaaaggaaaaagaaaaagatatttagaaaggacccatagtttgtcatctgaatgcagcagacatttaaaatggactctatcttttcaagaatatgaaatctactgacccctttcaaggggttcccccacctttcattgcctccctcagcagaggggttgctggatgccattactcagggaaacagttttgattccttcctgatcgcctattatctctcttgttttattgaaccagggtctctctgcaccctggcagaagctggcaattcatcaggataccatttagggaatcactgtgatgcttagtttacagtccacaaggcagctactgggagaatctggatcaatgtgttttatgcctctgaaatttgggcagcaaagaaagagtgcttcagttataaacatgcaatgtccatagttctcatcatccttctgaacaagcagaagctccccttttctgaacccaaatggagcaatccaattacaaagtcattaaatcccgttataaggtggttcataggagttcctgtttccagcaaaagccttttctgtgttcatccaacatatattctggcctcttgcactcagtttacaaggtttctaattaagctccagagaggatgatatagttcactgaactgagtcactatgctacaactgggaaagaagaggcattcctattttatcagaaaaataaacactttagtttcatttcctctgccacacatgttatctctttgtgctgtcacaacattttttataggtttttatttcaaaggattaccttgagattactgtcaacgcaagccagagagacatctccatacagaatataggggtaatattttttctcctaaaacatcctgctacagacaatataatatcatataatatcaccgaaataatctcccctattgagagcaaagagacagttttcaatagtactttggtacaaaatttgaggaaaataaaatgtttatcagtgacaaaaatacaatttaccagcttgatttttaagtcaaaaatttaaccttttaaacgatttcagaagctccgctaatttctactgttccttgtaacatctgtaggcaaaatacaacatgctgggtcataattcatagcttggcaagaaaatgttgcttaaaaacataaaggtccttttctttttatgcagaggaaaacattttagttattattcaactcaagtaaatgctcataaccatggaattaaatatttctgaagggttcattcctgagctttcttctgggttgaattaggctttctcagaactatacttcatgtcacccacatgtcttaagaactggtgccttctgctcagctgtgcatttttttgcagacatgccggatatctacgcagtaagtgctctgaaacttcaaagagacacagagcattctgtgctttctcttcccaccattccatgtaaacaccatgaataaccagaccattcttatgccaaaaggccctgatggcttgactttttggtccgttaattgttcacaatcactccttgcctgtattgtgcttggtaggaccacctttctgcagccaaaatccagccacttaccactgcatatacttcctacagcagaatagatactgaccaaagcctagtagaaacctgcatggcatcctgtctcttaatacttaatgctaccatgccctcagagtattcttattcagaatctaaacaagcatgtattcagaggctacaatgtatcaggcattggtggtgttagcagtcatagttcagtgaatgggaagaaagataaaaatccatgcctcccagtgactttaagtcctggtagggacaaatacagaagataagtaaataaacaagataactgtagatagtaataggctctgtaggcaataaacctcaggataatgtgatagagaatgacttggggattggtaatacccagatggggagctggaacaccgtccagggcagatggcatttgaactgaaacctgaaggaaaaaagaatctggacagcctcaacaccagatcaaacagtttttgaaacatagaaaacaagaacaaagcccccagtgggtgagaggaactgaagaagcctagtaggatggaagtataatgatactcatacactggagaatattgctaagcgcaaacaattctaagcttgtgaaagttccttgtgattattctatatttctttgaatcatattgatgaaaaattctttgtaataattcccatccaaatgtgacttcttgggtgcaaacataattttcacaacttatttaaaagcctatttaactttgcctatagcatgcttcacagaaatagtaacatccatcttacaggactttcatgaagactactatgtacggcagtcctcacttttttcctgctcaaaatcctgtctccctttccttttaaaagaacacagactttgttcgtgaccataatgtgttctccttaaaactacatgcatgcatgcattcctacacatatacccacaacctcaccactgcttgcagctagtgagttggcaagtatggcacacatagcacagagatactaatgagatgtgaatagaagatagatcttaaactcacgcattgtatttccctttactgttccctgtctggaaaatgaatgtgatgctaaaagaaaggcagccttctgtgaccctgaggtagctatgagaagttgcatatttggaatagttgaatggacagcttacaggagctgtgttctacatagatacatagttgtatgtagccaaatgcagaattatatgtaaagtgccacaaaacaaatgtaaggtaaatagtagtgtaaggccttcattatcatttatattactggtgtgttttaatgaagcattgaatttatttacagaaaaggatgctaagctgagatattttaaagtcaagctatataagaatttgaagggatatttaatataatatctgcttttccaccagccatcaatctcagcaaactcacacaggaccagaaaaccaaacactgcatgttctcactcataagtgggagttgaacaatgagaacacatggacacagggaagggaacatcacacagtggggactgttgcagggtgtgggggcaaggggagggaaagcattaggacaaatatctaatgcatgtggggcttaaaacctagatgacatgttcataggtgaagcaaaccactatggcacaagtatacctatgtaacaaacctgcacgttctgcatatgtatcccagaacttaaagtaaaatttaaaaaacaaataaataaaaataaaataaattaaaaaaaaatctttttaaaaagtaacacacctagtagctatttacttccataactattgtattttcttgccgtgccaaaatatctggcattgtaagaatgcacaattaaatatcattcatttactgacctagtatattgccagcaaagaacatgaagacatattctgctattgtttttctttctaccactgatggtggcaccaggcatttctcctatattccaaataaataatagaaaatacctttgcagccatatgagcgtttggaaattatcctagcaatctggcaagagcaaggaggttgacctggcctgcaatgatacgaacttaggggctccttgtggcctaaacttgtaccaggacaattctgagatcaacgttaccactgtcaatgagatagaagtcttctacacaaacaaatgtctgctgctcaaaggcctagtcagtgtacaccatctcccataagaaacttcccacaggaatctttagtaaacaactaaacagcactatccacaataagcagttgttatttattaatgacctattatttcaccaaacttatagtattaaaattgtaattagtagttgctatccattaagtacctatgagcctagcaccatacaatacagtatacattgtccttaatcttcatattacttaataatatgattaataatccccaaaatatgtaaaattaattgaattagcatacataggaaaaattcaaatgcattctaaaatttctttattaaaataagctagataactatgtggtcaaaatgctgtcatctattacctacgttgacttattgatgaatgtgtgtagatactttgtcactgggtcacttatgtcttgctgcttatccatgtctgcagaattttgcagagttcttccaggaaccgccaggctttctcaggataagatatatcagatgcattcagtgtgatcagacacattggggtacatttcacccagaggtgtacctgctgtttgtaatgctgctcaggatttgtgcctacaaacatgggaattctgataaattctatcttacacaattcccataaaaatatatgttgtgggattatggttacacttatacttttcaggtatattcctaataggagagacccatcattttgactaggcatctacaaaaacttaactctacccctgtcccttacaatttttcatgtttaatgtttagaagagttttcaacagaccatcttctagctccagatatttcaccttttctctgccactacccaagtatttttctatttctttaattttttaaattaaactttttttaagtaaatcatagatccacatgcaattgtaagaaataatatagagagacccatttcttccatatggcaacgtctggcaaaactattctataacatcgcaaccaggatattgatgttgatacagtcaagattcaaagtaccaccatcaccacaaagaccccttatggtgtccttcttccctcctgccagacccacttccctcctgcccccacctcctccttaaccctggcaaccaccaacatgttctctatttctatgtttttattttttcaaagattttatataaatgaaatcatacaatgtgcaacttttggtgactgcctattttcagtcacctgaattttctggagcttcatccaggctgctgtgtatatgaataatttgttcctttttattactgagtagtattccatggtatgaaaataccgcccaactatttttattgccaaactctgtagttcacattcatatcacaacatgacctccaccccagcaccttcatgacatgatgccaagtaagtcaacttagtgggcaaaaggaatgttccttacaggtattcaaattcagtttagcaatgcccgaattatatttggaagtttttaaacattccaaacttcatctccaactcaactttctcttagtaaaatgcaaaagttaactaatttttaaaagaaagaaaagaaaaagaaaaaattatgttgccactccaatcctgcctgatatgaagggaagtatggcagaggggaatacagcgtggaaagagacagtggtctcacacaattatggttaaaatattttacacttataaattatgtagcagtctgtgctcagatgaatacatggctagggcctcttttaggaatcttgaaagaggtcagaggaagcatgggacctggagcatagggctctttagaataaacctgcttcaactttcaaattgcctatatgttaacaggatctctcttgttaactggagaagctgccatgcttatctcaccaggcacaaaaatgcttccagccaagtcttcacaattgccctgaacaggtaaaatgaaagatacccacacttgaggctgatgccccagaatacaaattattaatgggtacaagacctattaatgacttgagtctgtagagagcacccagaaaaagaaagagctcttgatgtctcacataaaaagacgttttaattattgaacatttagtggcaggggtgagggaaggggagtgtgggagggcccaggtggaaagcagaaattttcctctacgactctctagcaacagcaactgccaatgacaacagcagctatgtgttgaacatttgttctgtgctagtactgtcaattcatttaagtcataaaacaattctttgaggcaagtactttattatgtccatgtttaaaagtcagacttattaaggtataatttatttatcctttttactgcaagcctcgaaatcaggtagtgtaattttgctaggtttgtaattctttctcaaaattattggtcagtcttggcctttagcttttccatataaaatgttatatcatcttatgagttttactaaaaagccttctgaaattttgactattgtcgcattgaatctttgatgaatttgggaataagtgatatcctaaaaatattgaatcttcttaaccatgaatatagtatatgtctccatttatttgggtctttaatttgtctcagcaacattttgacatttttatcaaacaaatcttacagatacattgttagatgtatatctaaacctctcatgactttgataatatttaaatgatatctccaattttcaattgtttactgctaacaattgatttttatattgatttgtttactgtgaccttgctaacctcattttattagtcctagtagatatttttgtaaattccttgagattttctatagaaagaattatcctgtttgtgaatagagacacattcatttatttatttttgatctgtatgtcatttatttatttctcttgttataatttacttggtataacctccagtgcaatgttggaaagaagtagtgagagtaaacacccttaccttatgcctgaccttgggaggaaggtattcattctgtcttttactattaaatctaatattagctgtggactttttgtagatatcctacatcagattgagggagtttcctactattcctagtttgctgagagttttatagttgaaaactattttcaatagttgcataattcattgttaactagaatatggtctatgttggtgagtgtttcatgtgtacataagaattatgtgtttcctgcaactgttaggtggagtgctttctaaatgttaagtagattcatattatcaagtaggttagtgttattagaatctgttatccaggtcctctatattcttactaaaattttgtctactgattccatcagtcaattagatagcaaagttaaaatatccaaccataattgggatatatctatttctcttttatgttttatcagatttttgctttccatattttgaagcactgttatgaagtgcatacaaatttacaaattattattttttcttggtgaattcgcttctttatgttatatgtctctttacttctgaaattattgattagctattacaatatatttttcactctttttctttcaacccatctatgttgttatattttaaggttttgttttatagacagcatatgatgtatttctgctttttgattctatcttaatatctatggtttttaaccctttattatattgctatttgttttatttttcctttgtctaatctgttctttttagtttttctctgttttcttctgctgtattttattttatgactccatcttattcccactttggtttattaggtaaacatctttattttttcaatttttttaatgattactgtaccgtctaaattatatttttaaaatttatccagtctatcttcaaatgatatttctccactttagataccattagaaaccctgaaacagtatacttttatttcatccagtccattctttatgaagttgctgtaatgcatttcatatctatataagtgataaaccccatattgaatgttgatattttttcttaagtttttcatttttttattaaaacagttcaaaattaaatcaaattcttttgtatttatcttcatttttaccacttttagaactctgtatgtcttatgcagatcaaaagtttcacctagtattatactcttgcttgaagaacttactttgacaatgcttatagtacaggtctacaggcaatgagtcctctcagatttgttttgtttattttttgtctttatttttataaagatatttttactggatagcaaattctgaattggcaggtttttcccctccaagtactttaaagttgtaactccattgtattttaatttgcatgatttctgcaaaaatatttgctattgttcttagttttgttaccttatgtataatgtgttttgttgtttttccttttgactgccataacattttctctttgttttggtttgcagtagtgtaagtgtaatgtgactaggtatattctattttatctatctatctatctatctatctatctatctatcatcaactgatcaattgattgatctatacttatactgcttgggatcacctgggcttctggaattgaaaatttgttgactttcattattttagaaaattcttacctagtctcttcaaaatttattctgccaagtttctctctcttcttgtctaggactccaattacacacatattagactatttgacattgcttcatagcagctggatgcaccattatgttttcttctctttatgtttccattgatatatcttctagtcaactgagtctattctctgctctgtccagtttgctcatacacccactgaaggaattttttatttgtgacattttatttttttattttgaccctttgcacatgacacatatttcatatagttttcatctctgctgaaattactcatttgcttacatatgtataacatctatccacgaaatcctttaaaatattaaacatagtttatttaacgtttctatctgataatgatgtctggatcatctataaatctggttttgctggctactttataccttgacagtaggttgcttctccctcaatatctctttctctctctctctctctctccccacccctgaccaatgagtatgtgtgtatcttgtaatttttggtttattgctgaacattgtgtttaaaataatatagactgaggtaaacagtctttatcctggaaaacaggcatgccttttattttctcatgccattcatatgcatgtcatgttgggaaggtttagtcagtctaatcagtttttgagcttggtttgtgttttgttattgccatggtaaccttcattccagcaataacttcacattccactagcatttcactgtcgataccttgtgcttaattggattttgtcataggaggattttcccctgtgttcttgctctattctcaatttttaacagtccttgtatgcttatgccatttaggagtatctctttatactattgttctgtcttaattattattttgcacattgttcaaggtgtgatgggtaaagtgggtagttttctattatcttgacccagcctcacacttacgtaagtcctgggtgtctagaccttgagaatggagctctctcagtgttcctgcccatcctcatggtagccaaatgtttcccttatttctgtaggaaggtgggggagctgggtgggagagaatactgttatttccccctgtgcattgtatcatctcaaaatcctgggtcctagcagtgttttttcctctctctcaaggaatatagattttgttttcattcctcttttggttccaatttacccctgcctatttctattggcaggggttttcttagcacttctgcagtagtacactgctattgcttattactcagtacaaaccttctggttggaacaggcagcttttgcttctattccttcctcctttccttttcctgggactggaagtagttgagtttttaactcctcctccagaagcaaactactttgcttttaccttctcccacaggcagtagttctttgccagggtgctaggagaagaaggagttacccaccccttttctgggatcagaaaaagggagacaaccagtattcatttgagagaaatatgaagatgcaccattgagggtgttcacttagttttcctccccttccctgaatactttctgtgggcacaagtagggcctgtaaatttaaaaaatacttagaaagtacagacttcacacatatctgaagtcctggggattctactctatcatattaactttacacttggccttttaaaacgtgttaaaaattttggctattttctccttactggctgtaattgacagtcacctctttctttcataatcttccaaaggtgaaatggtttatttgactaatctctttttggagggagtttctcagcctttgaaaataagattctgtgattagaagccttgtctctttattttttatttttatttttttttgagacggagtctcactctgtcacccagtctggaatgcagtggcacgatctcggctcactgcaagctccgccttccaggttcatgccattctcctgcctcagcctcccaagtagctgggactacaggtgcccgccaccacgcccagctacttttttgtatttttagtagaggcagggtttcaccgtgttagccaggatggtcccgatctcctgacctcgtgatctgcctgccttggcctctcaaagcgctgggaatacaggcgtgagccactgcgcccagccgtctctttaaaagagtaatgttttcacagattttgttgttatttttgttggtagagtaaaatgacattctcttgcagctttctacatttttagcgaaaagggagacaaccagtatcattttatatgagaaatatgagacttggagaggccaagtaacttgccgtgtatcgtaatctattaaatgttaaggccaacatttaagctcagatttttctgaaataaaagcctattgtcttaaacatcacactgcaatatatcttgtgtaatcttctcatcaaaagtacgtatttgaggtgtctaattaattctagtcagacccaactgttttcctttttattccaaatgagcactggaagcaatgttaaaactattcaacgagtcaatacattttctatcctaagtgcatctagagtacaagattttttttcttcttcaggtgagtatgcctagaaaatctaagcccttctctgatacctcagccattttggaaagtaaatgctcagcacttttgccattattaaataggcttgggtaactctaaaaatttctactagcgctgccttgtaaaaatgcacaggcaagcccaatgaggacatcatgtgatcacaggagcttgagcttaaaaagagaggacagcttcagggaagaagaattctgcatcaaattggggaaggcaatggagaggcaactcggaacagatggcacaacagaaagtagcttagtaggaactgatattgttaccagagaaagtatcaaaatcaaaggcagaggcaaagatagaagctagagcacagagaatggtcaagaaaggaggacagaattaggcttttgaaagaggtggaaaagtggtttggaagagatctacaaatgtaaaatatatccttctagtcacctgcagaagccatcctggtagttaggaacctgtgagagtctgatatgcagccagatggccctcacaccttggccagacatgtgtttatacagtaaattctatctcataaaccactttctcatgttatcttatttgaaattcatggcaatcctatgtagcagggacagaagatattgttagttccatttaccagatgaaaaccctgaaacagaatgttcataattcatcagattttccaaccatacctgcactcatagatcatgacataaacaacaatgctattttttcatcagtctgatcatgcatatttatgtgtgtatatttacttccaaggtgtctacagagttgcacacactctctgaatgttgctaagatatataaatgtggttacttttaaaaatcacaagaaatccattaatgattcattccatttaacaaattacaacatgataaaagggaagaaatttaaaaggaagaattctctccaaagttcaagcaacaaattttcatgtgatgttgggaaaagcaaaatgttttacagcttttagaggcgtaaatcaaaaccttcccactaacacttacaaccattttgaggttttattaaagaaaaaaattatctgaaaattcattacttggatgataaataggactagaaagaaagaggaaaggcctgcatgtggtaagtggaaggcattgatgaatatttggaacattcttttcttaagcccctctataaactgttttcctacatcatctttaaactgcacagatgggttcatgaatctggctccctcactatagcaggacattcttacaggcagggtctggacggattcactttttatatcctaagtgcccagcagagttcctaaatgcagtaaatgttcactaatatttggtggataaaaaatggtgccatcacaaaacacacatatacacacaagtacatatactcacataatagtagcacccataccattccataaatgtatacacttttatatatacctaatccatatgtatgtatatgcacacatattttcatctatataatgggctatatatcattataaataatacagaatcatgtaggtgttgttgctatgtgagtatgtgtatactcatataaaagtatgtttcatgcacttgtgtgtatatgtatacatatatgtatatagtcattttatctttgaatttttcacattatattttaatctcaaataagctttagtgaaagtgagttataacaatgagaataactgattttagtcttgactaatgagaatctcaattaaaaatgtaagtctgaagcatagcatgtcaaatatacatatgtttatataatataaattattttggaggtccccgatacttttcattacctgatcacaattacaggtaattgaaagttattagaaactaagcataaagctgtgcactcccgacaccacaagacctccaacccactagtcagctaaaaccactttctgatatactctgcacaatgaccctggtggctgtcagctctttcctgctttcctgcttccctggaacctgacagggccccagtgatgatttacctatgtcatgttatgtagtccacagcttgactgaggtcttgttctgattcacagcggagtgttgaacaaagtctgtctggaataaactgaatgcattcaggaaaatttccttctcgttcattcatttatttcctcattctcaaacattgagcatctgcaatgttacagatactgcattaaacactcgggtcacaaaagtgaatgaggcacagtccctgtctaactgctgctgaggtttccacagtgacattttcttaaaccccaacttatacagggtgttttcagagtgggattgtacatgttccaaacccaagtgattttgtttaataattttgaccatcaaaaatccagtttgaaaaatgaaccagaatacaaatatacaacatttaatgacagagaaaaaataaaggcatacagttttttaaagaaatatttcatcctttgaagaatactgagaaatctgagttcaaaggtgatgtgagcatgcttcaatcatgactatacacaacagaatctgtactcagctcagtattggctagagaagttctctttccctcatttaagccaagaccagaactccaaggctgaggcttgacataggtgtactgtaaatgaagtgttaatgagatggaaattctccaagttgcttttgagtctcactctatatcagtgtagacctgcctaaaatatgtaagagctgagaatccttttgaaatgattccaaactcttgagtctgaaaaccgagctgggaattcctttgtaacagttttgtgggttattttggcactttggtttataatcctagctggaccccatctgaagttctaaagcccataaaataagaatgaatggacaatgtaaataagccaaatttgagaaacttcagaccctgcttggctgaatgtttctgttaatctaccttgtctgtgctggtagaactgccattttgctataactcctttgtaaataagaaacttttcttctcatcaggcaggggatctttctcttcaaaggctgtgatgtattatactatattgaaattaaattgtttggatatgttttgctgaatactgataaaactatgatataaagcgtattatccttaatcaaaggttacttttatttgcagattttaaaggcaacaaaaatttttatttgacaggttctaatagttctagtttggcatacctgcacatttttattgtatcctgggaacaggcataaatcaactgatttcccacagacaaataaaagtggtggagtaatatagttcctggaatttaacacttcatggtcaggaggtcacatatgctaagttgcttatttacacgcctcttaaagtttaagtctgtgggcaagagacatgaagcaatgtgacttactatatcaatgaagaatgtattgttctttttcttcgggtagataaaattaacagtgttggaacagcagatcacacaagaatgtcatcagaaacatcagccattttttcaaatgtgcttgcttgatgattctctttgttattacaatcatcagttttaaacaatgagatttattaaacatttttttaagtggggaagagagagttagtgtgtaccaatcattgacatattagctggcatctcgaagcctaaacttgcagttaggccaatgtagccagaatggaggtgatgcagcaacccaggtgcctcctccggccctcacttttgctgccaaaactgatcttacagcccacatgttacagatggtgactgtaaactggagagatagccatttgacccacatttaactatgatacaagataagcgatagttattttcacagctttccatataaaggattttgatgagaacaaagttatatacaaacaaagttcatttacgcaacacaattgtattgagatcccagtatgtaactagtactaaacacttcttatacattattcccttttcacatgctcacccatttaaaatttcacagcattcttcagatcagtatattaaggcttagaaaagttttgacttgctaaagacacatagttagaaatcaaatgagtcaagatttgaatccatatctccctgctcagcatctacacttttcttcgctggagagtacattggaagcctaagctgatcacattccattaaacctcaagtcattttgagcccaaggcttcagtttcttcctttagaaatatatctcccttcaaatatacctggaatttacaggtgaaacactggcaaattaataaaggaaattacatcagtgccctaagaaaggcaggccaagagtgctggtaggaaccatagaagcaagaaaacccctgcagctttatcagagtccacatgcagttacttattgcagcatttaaagccttaaacccttgtcccttacctggtggcctcactggatccagcaacaaggaaggaggctgggcatggtggctcacgcctacaatcccagcactttgggaggccgaggtaggcggatcatctgaggtcaggagttcaagaccagcctggccaacatggtgaaactccatctctactaaaaatacaaaaattagctgggcatggtggcacatggctgtaattccagctacttgggaggctgaggcaggagaatcacttgaacccgggtggcacaggttgcagtgagctgcgatcacaccatggcactccagactgggcaataaaatgagattccatctcaaaaaaacagcaacaaaaaaaagccagcatggtacgcctgtaatcccagcactttgggaggcctaggcaggcggatcacctgaggtcagcagttcgagaccagcctggccaacatggcgaaaccctgtctctactaatgatacaaaaatcagccgagcatggtggtggcacgtgcccgtcatcccagctactgggttgggaggctgaggtaggagaatcgcttgaacccaggaggcagaggttgcagtgagccgagatcacgccaaggaaggaggtagaaggaagggttttcttccttccatattaaggaggccaactgcattgccaggactctcccggaggcaaactgaaaaatgaagctctttctgtttttctatgcaaatcgcaatgctgaactttctgagacctggcataatgcagtcacatgtcttgtttttgcattcagaatattgtcttttcatagtctttcagaatatgttaaggaggtttcactatatatcacaaatcatggtttaaatttcaaagcattagataaaaatgaccttacactgcatttgtagatgtcactctcaagccatcccaatgtagtttccatgggaactaatgtacatcaaagaagaaagagagagaaagagagactgtaagatcaaatttttagttcctgcctcctctttttctgggaaaaccaaaatgagccccatgttaaatgctgttgaaattagatactgaatcttatcttctatgtgaatgcagctttttgtttttttcctcctaagaaggagtactacctatatggtcatgcacaatttttccatagagtccatccatataatttataagttgtatttacagcctcagaaggcacatgtgcttatttaggaggagagtcaacatcatccattattactttgttttcaagttgctttcagaattattattattacacagatttacaacttgttgagaatccactctatggcaaccatgagtgaaagtggttcgtgaatgaaagtttatagtcacgtaagaacacattcctagattgtcctctgttggtgtagtgtctttcatagtcatatgccagacagtgtaacatgagtagctgtcattagcttcccatccaaaaagaacagttaccaaacagtattgttaaaaagagcatgttacagctattattctttttttcttttttttgagacagagtcttgctctgtcgcccaggctacagtgcagtggtgccacctcggctcactgcaagctccgcctcccgggttcaagcgattctcctgcctcagcctcctgagtagctgggactacagtcacgtgccaccacgcctggctaatgttttgtatttttagtagaaatggggtttcacagaattagtcaggatgctctcaatctcctgaccttatgatccacccacctcagccttccaaagtgctgggattacaggagtgagccaccgcgcccagcacagctattattcttaaatccaatgccacatatcaaggccaactttatctacctctgtctcataggactcacctgggttataaaataaattcaatactttaatcggggggtggttggagagagacaatgatatattatattctcaattataattgagaatggtgatataaaatgtatttgtagcctgtagataattaactagaaaaacaggtgatcatgtggtttaaaataacaattaatttaagaacttaaaataaatgtttttaaaaagatatataatagtattatatgtcttaataattatatttattaaatataataaatattactattatactatatttacaatagtatatactattatatttatatttataaatatgttatataatagttatatttatattatatattatattacataataatatataaatataaatataataactatattataaatataatagttataaagacaatatgacaaataaatattaaccatttaatttatatcagtcactaccctaaggattgttcttttatctaatacattttattctaataactctgttaattaggaattcatgttcccatctaacagattaagacattgaaggacaagaaggtcaaataaagggctgaaaaaaatctcgtaacttctaagtgaaccaggcagtttccaaaacctgcctcttagctattatgctataaatatttgagaaaagtatttacattgacaaataactatgaagtttttagaacttatgaagatcatggtgaagaaaaaactatttgtaacattaattatcaaattgtttattcctttctgaaatcatttattcaatatcatttatttgcagataataggtaccaggcattgagaaattcagaatgaataagaaaatggaataaacaaagggttataaaaaaatctaggatgggttattcattttaaaagagaatggagcttaggtaaaaaaaagcaaaaatatacacaaggccttgaacattctaacataatgagcaagtcataccctgccagatccatgagagtggatgacaggatgtgctggaaaggaacatgggaagtacctaaaatgaaaaggacctgaaatgtaattctaaagatttcgtctaaaagaaatggcaagttggcagataatttttaaattcaagtgtaaataatctgataagtattttagaaagctgactggatggtataaagagggtggattagagaaggaaaatatgggtggcagggagatctatgagggttttgtgatgggttgaatggtgtcctcccaggagatatgttgaagccctatttttggtacctgtgaatatgacttcatttggaaataggatctttgcagatgaaatctagttaagatgggttcattaaggtgggccctaattcaatatgactgttttccttataaaaaaaggaaaagacggagaaacagggagaagaatgccacataacaatgaaggtagagaatggggttacacagctacagaccagagaacatgaaggactgtcaccaacaccactgctaagagaagggcacagaacagattctcccgcagagcctttagaggaagcaagaccctgtcaacagcttttctgagttctagccttcagaactgtgagagaataaatttcagcttatggtactttttatatgacagcccaaggaaactaacacaagtattggtggaacacttcttcaacaaatagcacttgaattaaggcagcggcactaaaaatggagaggaggaggtatgtggtagaccagggatatatttgctaaaggacaaacgaagtaatgagacttagaaacagaatgatggagccacaaagaatgcctgaaatggtaataggatacatgcttgaatgttgatgggccccatttccacaagcctccaaatctgcttctagatcccattcgagcaagggaggatttgttaagaagaaaggccttttgagagcaccagtccctccaccagccagtctagtcctaagagctctgaaggccaaccttggaagtggtttaggagggaaaatgtaggacccaggatttcagttgccaagccggagagcaggggacccaggaaagaatattggcattcacttgatttttccatcttctgatataaccttcaaatgttaatagtgtgtcgaagaatttattggaagtgagaaacaagaaaacagtgagtctaacctagtcattctagaattgggaggtaatagaaaagagagaaatgggaaagttgctcaaatgcaagtccagtgaatcagagagaaaaggctcaaagcagcagaacaaagcttcaataaagagatattgtgacttggagagatggccttttgtcctttgttctattaccggtcagagaatggggagcacacccaagcctgagacaacagctctgctaagtgcccttgagagggcacggtggggtcagcaccaaagccagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaattaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccctcagactgtgtgttctgtgacatcaaagactggcaacattctaaaggtaaatgtaactatgcatccctttgggattttcagatatcttgtacaatctattttattcctctaaacatggagactataaagctgtgtggaaatcaatagtttaattcattcattcaacaaacaggtggtgagtgctcatcataacaaccacatctaatagctaacatgttgaatgattatcacacatcaactactatgcgaagtgcttttcatggtttatgtcatttaagtatcacaaataatactatgagataggtgctcttgttatgtccacttgacagatgaagaaactgaggcccaagtcccagtcctaagatgaggcagagctatgttagaattcaggtaatattactcaggaggccatgtattaaacctctttataacatatccctgtatcatatctgcattaggcatagaagactcaagggttatagggtttcagagaagggaagggctgaagggagttaattaggacaggctttaggcaaaaggtgatacatgatgttagctttgaagaagaggcagatttgagtcagcagagcgtgaaatcaaaggctcccaggtaaggaatgggaaagcacgtgagtgtagtccaaagtcaacataagacaaaaggcattgtagataatgaggggacaatttcgaccagaatggtgaccctatgagcagtaaaataagtccgagaagattgagttagccattggagagaagtgtctgacatgttggtgttggaaaatagaaaatcttggtggttttcttagtctaagcagtgttgaaggtaacagcagtggtacacaggatgaattacactaatagaaagcctggcacccaaggatttcagctagggtttgtagaaagatagaattatatgagatgtgttctaaagcaaaagtgataggacttgttctctgtgacatattgaaataaagtatatgaactgattataccaacaataactaactttattgagcatatactgtgtcctatagtggtttacatgtaatcatagattaattctcataatagcaccacgatttagaattaaaggaaggcccgttctaatcctaggatttctttcgttatctattgaagacaatgaaaacagtaattctttaaataatgttgtgttatgggggtattatgataccattgacaggagtgaaatagtttggaagtttaggagcagaaaaggacaattttgactgaaggcaagtaaaccaatcaggggcagtgtaactcattaggtcgtcataataataactattgttattattatttattttgattcgactatgaatcaagatgtcctgcagataccaaaatcagtggctgctcaagtccctgatataaagtagcctgccttgactacccttctttttataattataattattattacagctaattactgcatgcttattatgtaccaatgttctaaacatttcacatgccatagctcagttaagatagtaataattatagtgttcactattacaataataagagtttatatttacagtgctgatagtgttccaggcactgatatgtttttaaatagattaactcatttaatcatcacaaaacccacatgaagtagatactaatattctaccttcactttacagatgaggacactctggtccagagaatttaagtaacttaaccaagatcacaaaactaatgattggcagtgtcaggattgagcccagattctctggctgtagattctattctcttaacaactgctctacaaaatcatgagctttggggtcaggcaggtctgggttgcaatcccaaccttgttaacttactactagtgagaacttcggtatgctccttttttgtgtctaagtctcagttttcccataagcaaatttcaagataagataacaatagtacttttcatgcaataattcctatgagattaagctctcctacccttctctgtgcttattacattgcttcaaaacaggaagtcttcggtgtgtgttttactaatgaatgaataaatgaataaagcacttatcatccatgctgcacaattaacattttgttgtatgctactttatattatttaacttttctgtgcatgtacttttcttgtcaatccagctagattatatgcaccctaggactaaaccacatgctttttactttaatatgtacccagttctctgaacagtgatgtgcacatagaaagcttctcaataacgatgactcccatgaatgaagcatttactatggcctagacattgtgttaagtatttagtcttcatagcgaccctagatagtaagtactaatgttaattccaatttacagaataggaaactatgccttagtgagctaaagtgattttccagtggccacaccattagtccatacagagtcagattagattgagctctacttatctacagaagtcctgggcttgatcaccatgctgtactagcttggtgttaaagccctgattgatgggtaatttgacaagaagtcagagcccattatcacctgcctttggaagggaatttcctgcatctgaagttcttgtctatttggcccacttggctcaaccacctagttcacggcttttctgtagatttctcctcttagcactccctcaacaggcacaaaccacatatccaagtcagggatgccataaacagtggctgctgctgtggctggcccacagagcatggaagcaggaatactcatgagccccctctgtcatctcagtatattatggcttcagcattctctttgcttaacaacctctggctgatccactgtgaaaattgtgtgcaatagtcttcaaaatttctaatttcatacctgtggtgaagtagccttgcggctggtcaaagagaacacctttaaagctgacagtggaaaaagccttggctcctaaccttctgcaaaactgtttttactacttcatgcaagctgttattggtgtctttatttaggctgtatttcttcatttcagcgtctatgtttagcagttatataaaggagcgaaatgggtttaatggcctcaagtggcaaagcagtgacatgtggtccttcttggagcaacaaaaggtcaaaagactgtggaggagacttcttgtttcctggtgactaggagtcaaatttcttttatctgtctgagtcaaggggaaatgatgttcctttgaaagtctcatcttgtaggtagagtgtaacagagtaggaaggtagggaaggttccttaaagggccatgcagataatctcatctgttgatttgtcctattgtgggtgatacagactcacattccctttctggagaagggagggttttaattaaaactaaatagatatccactgggtctgggtatgtacataatctagaaactgtgggcttctcaaggcctctgcattcagcatctcaagaagtcctatgggtaccaattgatccatcctggaatcactctcctctgcttgcatgggacttgcctttctgccctccttccttagcactcccaccaggctaggtatgagccccgagtaaggagccctggtctgattccagcttctttctcttattgactctgtgatttcaataagatatttgactttacaagttctgcgtcttcatctgaagacggagactataatgaaaatacaaaccttatggatttattgtgcagagtagaaggacaaagtatacaaaatgctttggataattgttatctaacatcaaaatttaggttcacatacctgatgcacagtaagccaaacactgacacatcagcataaatgtttattcaatttggccaaagtgagagggcaggaaagacagtctctaaagtccaaccttcctttacacataactgggggcttctatgagtcaggtaggtatacaggaaatgggataccccaaagaccaaagctgtttatgtctcttggcctgatcagacttctggatgccatcaaggtttgtgtgacctaaggttcatttttcttctccaaaaaaaatacagtttatcaatcttgcaggccaggggtgtaaggatatgaagttactagtgactaccttctaccaaaatgactatgtgcaagcaagcatgcatggaggcagaaaaaggcaaggaaaagagaaaactaagtaaaacaaacatcttatgattcttataataaagactcagttacacaataacgttgtgcacactaaaatcccaatgaatgggtgctgttagtataggcagctggcatatttttccctagaccaatcagtcttgtatttctgtttcaaggcagcctgcacagattctccaaagcaattctcagcttattcatagtagaatcaaaataatcaggtgaaagaaaaatttattcataaattcttaatcaaagcttccgctgtacccaccctgaagcagtatgagcactaaaaccatcctatttctttttattatactttaatttctagggtacatgtgcacaacatgcaggtttgttacatatgtatacatgtgccatgttggtgtgctgcacccattaactcgtcatttacattaggtatatctcctaatgctatccctcccccttcccccctcctcatgacaggccccgatgtgtgatgttccctttcctgtgtccaagtgttctcgttgtttaattctcacctataagtgagaacatgcggtgtttggttttttgtccctgcgatagtttgctgagaatgatggtaaaaccagcttatttttaccatctattaaatgggacaaaaacttcaatacttctacagttgttgtatacaattaaataatcttctaaatccgattgtccctccttctcttcttctcctttgataaacaacacacctctctgcatagagcaacagaacttccttttgattctggcccacaacttcctatgtacacctcgtttgtaaagaagctcatctaaagtcaaccagcaaacgatgggccctccaactctgatagcctgtcaccagccctaagctgccaggcttcctttgagtgtctgtcattggtgagatatagggacgtgtgaccattttgccatggctctatgttgctgaaccaggtgggggtgtgagtggcagtggggcaagtggatccttttgatcattagttatttttgagtattgactttaatttgtaaaatttcccatcttaatctctgccctagtctctaagcagatcccagggcattgaggagagttcaggtatgccagcatgttttggtgtttttccaatgccaaaataatattttgcccactgaattcacaagtgttttagatggtcatccagtttttgtattgacccctcctaaagaggtaacagttatcccttggtatcaatcaaggcatggttccaggacctcccttggataccaaaatccatggttgctcaagtccccaacataaaaaaggtgtagtatttgcatataacctacacacctgtgtgtatatttgcatataacctgtgtgtaggttctcccctttcctttaaatcatctctagattacttttaatcctaatacaatgtaatttccatgtaaatatctgttacactgtattgtttatggaataatgataagaaacaagaagtctatacatgttcatatagatgcaaaatttttgaatattttcaagccatggttgtttgaacctgtcatgtggaaccaagggatacagagggctgactatattttaaaaaatgaaagaatattctttgaccacagcagggggctactggcatttggggatggggacaaaaatgttaaatactttgcaataagaacattaacacacagtgaaaattgtcatgtcaatgctcccttcgttgggaaagctgcaattagttataccttttctctctcctattagagaaatcaaccaagccaagcctgagtatctcagaatcagcatccttcagactcaaatttgagtcctgactactcaacatctataagcgttaagcacttactttgtcattcaatactcgtttaatctcctaaaagaacggcaagcttcttattattgcccctactagtggaaaaaataaagccagagaaagcaaagattctaacactgagcccagcacaagtctaccaccttatgctgtttctatgacgttaactttatagcatgatctggattgctaaaaatgttcaagtttgggccttataacaatagaaagaggactatataaaactacagtaagactaaaagtagctaaaacatattacaaaaataaaaaactggagtacctcgattatatacaaaagagcctttgaaaaatgtctaggtgaatttttgtctatgtacctatgttgacatcacaaaataacaactatcaattcaaaactcattccttctatatgtttttctcatatcgattttaatcaaaaggcttaacttgaatattaatctttcatgtcctccttatctatttgaccctctggaatactgctgagtaatgtggcattcacaagaatattactgtgtccacttaagtgatttaaaatgtattctcaatagccaaagtgtcctcctgactctttgaaattcagccatcctatgtttcagatggcctttcacttgggcttttaaaccactttacagacatctctttattctcctttattttataaattgggaaatagatcaaatagaagttaagtggcatatagaggtcaatggcagattactggaagacccagggaaaggtatcacccttgactcacctagagttatccctcagataatttaacatttcttcagaagactgaggtagcctctgaatgtaggaggcagactaaaagattattttttttcatgaggctgcctcaagcagattcacatttaattgtgattcaactggcatctcctttcttgctgccacaaaatatctatattgaaatcaggttgactgttcatcttttctttctgttacgtctgctagggatcaatagagataaaaatatttggagctttgtgttcaatctaagttcctgcatgcagttgcttgatagaatgattttgtaaggaagcaagtaaccaaagtatttttgcagtgtttttgataaaggactgctctttgctggtgtcctcctctccactactaattgacaaaacatcttgaggaaaacatccatatgtttaaattatccttaaaagctctattggcattaaaaaaagacctccgttttgataaagattccaataactatttggcttttgcaagtccagctttatgactagaaatttctagatcaagagtctgcaaacgatggtctagaaccaaatacaactgctgtctgtttttgtaagtaaggttttattcgaatacagtcttgcttgctcatttaaatattgtctaggctgctttcatgctacaatggcacagtggaatagctgggatagagactatatggcccgcaaagtctaaaatatttacaacttcactatttacataaaaatttgtcaacaactgttctacattaaacaatatatcagccctggcagatgtaactggttaccttgagtatctcatagcatgtatgcagtgtaattttcaagttcccaaacaaaactttccaaaagccatttcttaagaccacacactgtagagtcagatccaccaagttttgaattatctgaacagagctttgcaaatgtcaaaccagtatagtagatgatgacgattttgctgaaagatcactccactttcatcaggggaaacaagctattgggaatatattttaggacctcaattttccacacattgctctaattactagagtgctatagatgcatatctctgatttacagtccgccaagtcaagatttctgaatttcttggcataagtttggtagtacagtattactttgattatggcttcttatatctggcataaaaatattccctttgtgcatattctttttagatacagtacaaaaaaaagtatgactcttccttttttctctccctttactttaggaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataaggtaaggggaaaaatgtcaaaagtacatgaaaaaaatcatctctaagaaagagcaacaaatctgctagctcttaagaacttataattatcattgctggttaattggtattatagattacccagttctgacatgtaattttctaacacaaagaggtttctatcatgttacattgtgctttgcatttagggactttttattttacatttacacactaaagaacgaagggcagaagtcttgaaatatgcaaggatttagataatgaattgcatcctaaatttagaaaatatatcagacaatacagatgattcattgtagaatttgtaattctggaaaggcaagttttggggaccattgtttataaataagctaacttttattggctcagatctggataagtaccagaagcattaacgaacatttcttcagctgcacacggaccttcaaaaagttctaaaacagggtatgttattatgttttacaggaagatgtgtttaatatttgtaagtcaatatggataataacactgatttaaatggactgatagatgcatttgtcttttaatgtctattataataacaattgccaaaagcctatgaaaaattcaacatttacttgttgattagtctgtttttgattcatatatgcaattaattcttaagtgaagtttttcagagacactagcctctccttaaaaggcaaccatgttcacttgaaaatgtgaacagactatagatttgagattctggcttcacgctttgtcctgggaagcaaccttggatttggaatttaatggcttcctggctatctggactgtgaagaaatgcttctgaggggagacagatgtttgtctgaaactctattgtttaaagagctggactttgtctgtaacagcaggtatgaagatcagaaagaaagattgggagcccaaatgaaggcattagtactttgtaaacatagacctcatgccgcagtctgggtggattgatgataatgctacaaagaaaaatgcagcaaaggaaacttaggaatgaacctaaaagacacagtgtcttagtaaactaaaacgaaagtaaaaggagaccttcaaagcccactgcttgtaagatgagcttcttttttgaatattattccttaaaggacaccacacacacccaggtgaactcatggaatttgcattaaataattgataactttttgacatttatttgaagtttccttccaggaaaaaatggttcaagtagcactctggcattatttcataattaagcagccttttgcatgtaccatatgcaaccaccaaatctaaggtcctgtgttatgtagcctttccaacctttctaaatctcaagttttcagtaaatttaatgttttctttagagaaaaagacagtgagagacaggcagtgtccatttgaactagcaaatagtctgaccagatgacgagtctactagctcttctagtagctgctgcaaccagcaacttagtgggggcaacatcctcagccatgccacgtgggctttgcctgaagacaatagataacagccaagaggcagacaaagaaaatatgtgtaaaaacaatggtaaataaagtaaataaaattaacgaattagataaatgaataaaaataaagagcaaaagcaaatgtcaacatgcatcaattccccatccaaattacatacctcatgtaatttttgtaaacattttgtaagatttaccttcttgatttatcagcaatcattctggtttgcaataaaataatacctgtaagtggtttaattggaactgctgccactgcttgagatttatgaattggaatattacatgataatccacaggatcaccttgctttcctattgctgaagtttgcctcaattcttccttccattcattcatttactcaacaagcctccattgaaggtctgctataattcacataggggtccccctcccttaagaattgcaaattatacatgcaagagaaaatattgttttcactttttaaaaattatttcatttctatttttaaaaagagattgttttcagacagatgggctaccctgtacattttttactttgacaagtacattctgcaatgttttgtgggagaactgagtttatccttttgttaacttcaaaaggtcaggtatgtgcctcaatcctcatttgtttctattacaaacatcttaggaatccataaagttatataaactttcaaatactttgatatttgatgagcaaatctatgttcattctgttcataacctttatgacataccaaacaccaaccattttatctccaaattccacaaatgaaggggtcattatcacccaccaaaaagcggtttacaaagattttaacaatgtataaacaatcttgcttgaaactaatgaactcttacaatctttctgtctttttttaaaatttttgccattacttgttaaagaaagtgaccctattggatcgtgttttcacgtaataaattttctgcgaaatttactgtttagtccttggaggcatattactaaaaatcaaattggattttcttctgaaagaaggttacagagtgtgacttcatgagtggaagtatgttatggctaaagagcccatatttcatgctgtaatatagccaagttacattggtatatatattccttggccattgaaacaatgttaaacaatatttttcttttgtctaagatacagttagttaagctgtcattaaaaaataaacaaattgataatcagaaaaaaaaatcagagcaaagcaagctgtcaaaggttggctgtaaatccagcacaaggtaaaatgtggctattttaaaaagggcaacttcttcctaagataactgtttttttttttctctgcttaaaatagtcattgagggatattcaattgggaccagagaaaggggaagccagaatcattcatcaggcagatactttgtgtcagttataaacagtatatttcaaaattaagtatgagaaactccaggaggagattagacatgaggaaacaagctcagtaaagctaagaatcttgcctatagtcatctgtgcagtaagaatacactatgactattacagctaaaatatctttttaaatgccaggtattttctattctaattcttagaacaaattagagaactgagatttagagtggccccctcctctgcctaaaagcactccagatctggtcatttaatctctttggtatgccacttgtccccagggaaccaaactaacaagtttttcttctggtgtgctctttagcaaaaatgtagagtcatcagacattagtgtgtttgttgccagcttcgtgtgtgtgtgtgtgtgtgtgtgtgtgtgtgtgtccctctctcccctgcacttccaactgatttaactttccacttgtaggtgggtgtagctcagagaagatcaagaaatattgcactccctctactcaatattgtggaacaaattaaaacatgttcaatagttgtgtacctacaataggtaggagagctaggggctggggattcaaagatggcaaacacaatttatgctcctaagcaaatacacaagctcagcaatgggatagacaggatcaagtaagactgaatgtgctgtgctataatttgggcacagatcacatcctcttaatgcacaaagaaagaaagaactccaacaatgagaggagaatggatgggagggactgaggcaaacttcctgatgcctgtaacatttgaactgatctggaaggatgattataaaggattttaattgacaaaaacaatggtggaagagactgcatgagccagtgcaggaacattcttacattctaattatattcttatattctcatattctcacaggacattatctttaccaatgttaaatgattaaactaggtaataaacaaggcacacaatgatcaaaagaaaggggctctggggatgaacattctgcctttaatcactaatggtgtggcctaaactgtggggattaacaatgctctgtaatacccctaactatgcaatggggataagaagaacctctcctccacctgggcattctttattgttgtcttcataaagacttaggtgtatggaaaattgggcccagtgactgacatatgacaaagcacttgaaacatgattctatttttatcattattagttctaccaataataattatatacaattaatagaaataattcgcttccccaaaatcaagaagatagaattttaatataaaataaagttttaaactaaggatatttttcttcactagtagaatttttgactcagcatcagctggcaaaacgatttaggaaaattaaggaaatgttctagcatactccaaatcacatgatgtagttgcctacatattccaaaggctttcattctttgctcattggcatccatatttccacagaaaaggtttgcaagctcagggcatcatgctaatgtctaagacattccatcaccattaagggactttaaaattattcctagtgacaacaatatggttctttgtgttattaagtaaatcatggaataataagaacaggaagaacactatctcgttcactaaataaatgatcactatcattaaagagctattaaaccaaattctatcaggtatttttttaaagatgtgttcattctttctactcacttgctaaataagaaagaagaaaagctcaagagtctttaagcagaagctctgttctgcagctcacagaatggattaacaccagctggaaaaatctggggaaagtaggctaatccttgctaagttggtggccctatctagctgctgcagaagctgcagcatctgggactggcttttactcccaactggcttcacccttcccctataactcttatcctaatgttattcaaagagaattccatcatttgccctgatataagcatcaggcacacaaagtcaacccacagacactcctgcctatccctagaaattttgaaagctccagtatctgtttagcactagtaaatcatttcctgcttggtcaatccatattttactttgcgtatacagcctctacttttatccagttatatttaattaataaaaataattcctgtcttccaactataccaaggaaaatttcttcatcacaccattttagaacatttatttacaacatacggaaatacaattatatctttaagttaacaacttgtaactgagataagaaggcattgcttctctgagtttattttgttagagctgttcttttttttttttaaaggaagcttctgctcagaaaatgtgaaagaaataatctatctcaagaccttgctgttcttgactgttcaaaaattctttaaataaaatataatatggaagctgtgctctgcatgtcgagaccatttcactgttgagccttcacagccagaaaacaggctcaaaataattagacttgaacaaaatcacattatttactttttgctttaataaggaggtgattattagaagatgaaccatgactaccaagatagcaggtatagattctttttaacaaaattaatttagattatattcactatcttaagatacttatgcacataaatcatatctctctacgtatttttgcatgaaacatagagtatatgaaataaaatgaatgcaatgaatagaaatttaatcatatatttacctgaattattagattattcataaatagcttattagaggcagtaaaagtcgacagagaatgattgcaataggcagatgtgatgtaagtctgtgatattttagaagaaattttcctgtaaatcacacatgaaagatgcagccactcatgctggacaactgcctggtgttcccaagaaacatagggacaaccaaagggcacctcagtaagtttatactggaccatagataataaactcatcaacaaacaccagatttttgttctggagaaaaagatgaaagcttttgaacagtactagtcatcaccaaggaaactgtggtggagtaaaaaaattttaagaagatatcaacattgcagtaaatcaacctaacctggaaatgtgtttggtgacaaactgaattttcctaggtgtcggcaaactaactcttttaaggccccactaggggccttaagtgatctactccccaattcttccatagatgcacaaaaatactaactgatctattcattgtgtgtctttagaaatgcagacatttaatgggttacgaagcttaactgctagacacattcattagatgtgaacagttaatatgtagtcatttctgttggcttctaaaatatcctcatcactcttttgagacatagcagctcatcctaggccaatgatatcaaccatggctgtactgtgaactgtaatccagtatctttctctcaacacctcctctcttctcagctaagggtgttgtatattgaagatgctctgcttttccctctgactttcatcacttaaaactttgttgatttcacctgaggcaaattgacaaatatttttaatcatctttcacctttctttctcacttccaactcttctccaattgcctgactgaaatttctattccttttcctgtttttttcctacatatttcagaaatggccctgatttgagcagaaaatattaagaataatgctaataaaaacacattcatgttttcaaatgtaattaaattttaaaaaagttttatgctcaaacatttctagaaatatcctaaattacatttcagaagttttataaactatctcagctatttcttttcctcttgaagtgaatattttatcatcatacatattcaaaataaataaaatactatgttattcaattattatgttaccatactactgctgttttagttcattcagctataacaaaatatgacagactgggtggcttataaagaacagaaatttgttttacacagttctggaggctgggaaggtcaaggtcaaggcactggcagatttggtgtctggtgagggtccactttctggatcatatatagtgccttctccttgtgtcctcacatggtcaaaggggtgaggggtctctcttgagcaggttttataagagcactaatctcattcctgagggctctgaccccatgacctaattatctcccaaagtaaccaccttttaataccatccccttgagggttaggattttaacatatgaatttggtgaggacacaaacattcagaccatagcaattgcctttttctcataacatataaactctcaaactatattatatggtaattagactttagaaattagttttaaaaatctaactacaatgttcaaacaacgaattcactaggaaacttttagaaaataactgatttctaagttggagacatactatgtaactgtattaagtcacaaagctcaaattcagtttttctatttgacttcagtgtcaagattcttcacattttgctaggctacttactctccatgttcaagttatctctaatgactatatcgaaatagaacacagatgaaagcaaaaatagaaacacagatgaaagcaaaaatagaaattgaaccacaaacatgaaacaggtaacaaacagaaaatgtctctgagaaatgccttataattctaaaataaatttggaactagatttttgcagaatactgcttaagaaattaaattgtaaaacataagggaatcatttgaataagccattaataagattaatggaaaataatttattctcattttatctctagatgccatgtccagccaaataaatgagactgaacttcatggttgttgtttttacttcatcccggcaaaagaaatgaaattaaatataaaaagcagatgaccaaataaagtccaaatgaattaagtattgctcctagtataactcacagttaatataagttgactatcctctctgtagacaacacttttcatcaacatttttcaccatacagctagacctcaactaacagtcaagtgtcaaaaaaatgaatcactttagaaaccatcttaataatgagacaattgacttctggtacccaatttagaacatctacaaaaggagtggtgagcagatttccactctgatgcaaaatcttattcgttgggcattgatagctgagtgctgtgttaaggattctgaagtggtaaatcacaaagaatgctgtcaacacacttagtaaatagttaacacaggacttctctagtattaaaattcataatagtggccaggcgcagtggctcacacctgtaatcccagcactttgggaggccaaggtgggcagatcatgaggtcaggagatcgagaccatcctgactaacatggtaaaaccctgtctctactagtctctactaaaaatacaaaaaattagccaggcgtggtggcggacgcctgtaatcccagttactcaggaggctgaggcagaagaatggcatgaacctgggaggcagagcttgcagtgagccgagatcgccccactgcactccagcctgggtgacagagcgagactctgtctcaaaaaaaaaaaaaaaaaaatcataatagcaaataaatggcattcacgttataccatctccttttttgctcatggcaagtagtgtaatccctgccagaacatgggaggagacaatgtaacacatgtgccattcatttactcagaggtatacagtgtctttccttatgtgttaccaagtttaggctgtctgcacccctctgtgcactgttttttggagactgttccaatgtcactaggtaagatgctaccccctgtgatatagcaagacatattttgtgcctagagttacaaggaaaatcttttttttttctatagaaacaagactaggcatgacaagtatatgtagttttatttgttcaacaaatattgagataatacactatggttagtactgatgtatatactaaccacagtgtattatctcaaaattagatatgtatacaaagttgacccttgaacaatgcgaaggttagggaggctgacctacagtacagtcaaaatctgtgtataatttttgactcccccaaaacttaactgctaatagcctactgttccttggaagccttgctaataacataaacagtcaattaacacatattttgcatgttatatgtattatatactacactattacattaaagtaagctagaggaaaaaatattaaaatcacaagacaatatatactcactatttataaagtggaagtagagcatcataaaggtctttattcttatcaccctcacaccgagtaggctgaggaggtgggaggaagaggaggaattggtcttgctgtctcagggatggcagaggcagaaaaaaatctgcatagaagcggaccccctttgtccaagcccttgttgttaaagggtcacctgtacgtctaattttaccatagtctttttgatgatttcaggtttaatattgaaactttggctaaaattcacccatgggaaaaatagaaagtaccatggatttttatataaaaggagtcctggctatactatttacaaagcatgctaacatatcacttttcttctctgagtcttcacgttttctgaatatcaaaggtttcaaacttcagagagctgtatgggacaaatcaaataagacattaaaaacgcgttctggagagtaaaaatgctagcagatacaggtgtctcaacttacttgttaccttccatttctgtcccctactcacattgctttcttttctgtaattgtgtttaaagctgtccaaagagactctccaaatgctgggctctctgtctggaagtttcaaatgaggcttttggatgtgcatctttttctctgagggtaggattggggcaagaaagaaggtgatttaagtgtactggttgcctgggtgacaattaactgggtattgcttttagggagtcatacagaaaaatagaaaagaccagtaaaaaatgccatcctagtttgaatgctggatgtagtgaagggggttttgatgaagaaactgttgaggatcaactgagattagaaccacttggagaattaaaattttaataaggaggcattactttaaagtgaggggagggatttatcctaactgatgccttgttaaaaagaataacacagagtaaatagtcctaagaacaattgcaatcctttgtagtctgtaatttgtaattgctgcacataatttcagttaacaggccataagaggaacagtcacaaataccaagaaaggtacatacggagataattccaaccaaggtgagcacagcctacacataaacaggatgtaagtaccgcaagtcaccaaaactacactcaggagaaagtgctcgttattaacagacagtggattagtttcaatatctacaccaggggtcatcaaataggcccacagggtggtcctggatttgcaaacacagctttttgttgttgttgttgttgagatggagtttggctttggcttttgttgccctgttgtccaggctggagtgtaatggcccgatcttggctcaccacaacctctgcttcccaggttcaagcgattctcctgcctcagccacctgagtagctgggattacaggtgtgcaccaccctgccaggctaattttgtatttttagtagagacggggattctccctgttggtcaggctggtctcaaacacccaacctcaggcgatccacccacctcagccacccaaagtgctgggattacaggtgtgagccaccacacccggccgcaagtagagttttactggaacacggccatgtctcctcatttgctattgtccagttgctgcttccacactaccaggacagggctcagaagttgtgatagagattgtgtggctggaaaagcctaaaatattcaatgttctggccctttgaagaaagttaactgaatcaatctagactgttacacttacagtgaaaataattaaggattaggagttggaaggataactcaataattccattcatttgtgatgtgtattgtcattatttcattcaatcagcaaataactgtgataacatgtgcaaggaaacatgggagatgcaaaagtttagtaaagcaggtatcctgctatagtggagagagctcaggactatgcagacctgggcttgaaacccaacttgaatggattaagtggctttgaaggagttacttggactctccttaaacctcagttttcttgatcatttcacatcatcatttcataatcacgatcattttctatgggcatatctattcaaaatctctctatcagatcccccagtcaatatggagattgtggtaggcaccaagacaggaaggtgtgatttaggatcaactggatttataattttaaaagaatttatttatatgactgatgttttgtctggtggagcctgaagtaactatgcaaaatatctttgtattattactgcttgtttatgttacttatatagttatattatttcccaatcaatttcatcttttgtatttttctcttcaaaagttttgggctttacaatctcaaaacacattttcatcattcacatatttaaaaagtgacttttttcagagttttgttattgaagcagtgatacaaaactggttgactttttttctggggcagaggagagagtcaccaagtcaattgaattaatcatttacctcaccaccatatataccagacacagataagacaaactgacttttataaaatccctgcaaacccatcattacaaacattaactgggtcaatttcacctgaaggcaggattactctttcctataccaattttggatttcccagattaacccgttttttgttttgttttgttttttttaagaagtgtggcattagcaacatattcaaaagtctaaatgcttataagctgctttgaaaaacacattcaaaagtagaaacaaggttttagggaagcaaagataggaaacatgaatgagggtttagtaaacatagcataagacacttgttatcgaggcaaaaggattaattgagcagtaacatcatcagctatggttggacagaggagtggagataccagaagtgctatatccctgcacaaataaggaatctattttcagtttagactccaagcaggaagatactgctgctgcctcttgaagtacttcgttctttttctctgaagcttgaaaagtcactttacccaggagtggtgaatctggggtgctgtttctgtacctcttcacgcaacttgattggcatataaagatattgctataggtctctgggtacttcagtttctattgcctaaaatatgcttccaaaattagaaaatatgagcttaactctcgtaacagctgaagaagagcttacaaccttagaagacatagctctgtaattctgaaataactcaaaaactattttaaaatttcttcttctccagtcttccttcttccaacacataacattttcccaagggaaggcttgtaaaagcttctcaacagagaaaactcttaggaaagaaatggaaaattatagccatatcaatgaaacctaaaaatcaggcaaaatacataaaagggaaagagatgttattcctccagatttatacattcacatcttaactgatgaaagcttctctgatagaagtctgccctgaccccctgacatgacataacctccacagtcatttttttcacaatcatttcttatattctcctgctttattgtcttcatagcactctgtcactatctgaaatagttgttctgcttgcaccgttactgacaattcctcatcccccatttcaatgtagacactgaaatcagagcctcttctccatttagcttagtgtctagcacatactacacattgaataacatgtggtgaatgaatgaatgaatgagatgttccatggcagagttcatctcccacctctggttgatattcagtcccagcaaggatgtgcagctatcaagaagtaagcacacactccaatcttacatctttggggcattcttcttcggactgttgcaaaaaatttccttgtaatgtatacagagagcaactgaaaactctgaaactctaacgcattagacaaatatagatcttttaatgaatacttttatttaataaccagaatagcccttaggtattgtctaattcacagccctttatatagcaatggagaaattaaaattaaatggcttttttttccaaggtcacaagctagtcttagcttgagccagtatgaaatgccacgtctctgaactcctagcctggtgctcattttactggagccaagaagataccttcattgctgggcaaaggaatgaacaatgattgagtacctaacacgtttctaggcactttgttaactggttgtggtagacaatgtgtgttgctgacccaagcaccatttcttcttcctttcttccttacagaatcccaaatttttaaagtaagcatcccatcagtagctctagagtcagattctgtctagtctaagtcatttcatgcttagcaggtcccattacaacagccactggtccaggggtggccacgtaatttaatttggttcaatcgaattgaaggaaaagaaatgagccatgcctggaggacatgattctcttcccaccttcccctttcctctgctagttataaacagggcgatctacagcccaatggctgcctgtagccatcttgtggccataaagagattcatctttaggatgaaatcactgctgaagatagtaatgtctatatttatattaagggtcagtaaactctgcaaagaatcatatagtaaatattttagcattgccaatctgatggtccttggttcctgcagcaactattcgactcagacattatagtgcaaaagtcaccagaatgacatggctatggttcagtaatatcttgttttcaaaaaaaaaagtcatcgggctgtttaaatcattgaacctttttgacatcattgagccacatatttcatcattccttgagcttatcctgcacattaactcccaatatttgagatgatcaatttccttatgatttaaactggctttagtaagataatttttaaatgttattactaaaaccaaatcaatataattaattcagcatttatatacattattactcataatattcacaaaactcccataaagctgatattagtagactcattcttaagataagaaaatagaaccaaagtttcagagtctttgaaaatactggttcaaaaaccggcatttgaacctatatgtctaatcttctactctatgatgacccaactcccaactatctattcctcagcacttaaaagtggaagaacagtagctgcttcagtaaagttccaaacccaccaccagcttatcaaacagaaaatgatttcatgcagggaagtgtgcacttagaaagtcttttgaagggctggaggaatggatgtcagtggactgcccctgaatttttagtttctaggtcataccattatatgtgaaatccaaaagtcaggcagtggctactgctatcagttcctaccactgtagccaccatagcctcctcacaccaatggctccccagaatgtcatgttgaaccactataaacttcataactgtcaaattttacccgtagctacagctgcataaaaatggcctctgcctcacttctgatttccaaatctcttacaagtgcatgtaaatgactctagctgcaaaggagtttgggaagtatactttttaacctctccaataggaggatcaaatggagattggtaagacttctcttcagaagattgactaaggcttctccctagaatgtctggcatgtgtatctcccatacctgacaaagaatgagggcttcaagacagctaaaaaattttgaacaagctttaaaggactattttctcatccccagtcccatcagctgagccagaataatgacttcatagtaatttttccctgtacctttgagggaaagtaatgcattcattattggaataaaagtggttcatgtgtataaatcttgcccttggcaaaataaattatcaaagctcatgccaatgggagagatggcaggtccatgatgctaagagccaagttccataaagtgatagggaagcagctttcttttatccaaaagaatttatgttttatggctcagtgttggtgaggtattgatcttccaaatgagacactgtggccactgtaaataaattcaatagatgtgtagttggcctaagaatataacctcagttatttaaaacatgtggcacttgatgcagatcaccttccagtgtcctgtgtggaagaatggagcttccacccagtacaaagagtactctgggactccatgcctaagctccttaattagcatagtacatgtttgggggtaaataactccacctctctcaatcttaatttccacagccctgaaatttggacatgatagtatgggaggattcatgagaaaatgtgtgtggaatgatttgaacttcttgaagaatacatactcaggaatactgctatttgtgatgagatagtgtcagatgcataaatttgggttctttgaattactggcatacaggaaaatagcaaatctaggtcaacagagacctttttctcagactgcctttactatgaataaaacacaaaggaacttttctaactttctcagaaaagtgtcaacttctataattatttcaataaataatcttcctccaggaggatataattttaaggtgtgtgcagtgtccttttaaagacaggtttgtaggtctcactttcttttatttccaagttatcccctggcaacaagggctgtttatgtggagtattaaacaagcttcaggactgtgcacagaactcactcctattatatcttattttaatctgatattaccaaacttcccatgaactaaaaaaaaaaaaacccataaattttaagtccagtgagatttctgttttctctggaaattagagagctgaactgtgttttgtgtgagatcatccaacagtttttttaaaaaatcttacttcagaatcacattgaaatcattatgtcttctggaaaccagctgatagccaaaacatttatttaaattgtttataaaatgggtgggtggtatttcataatagttattggtttactatgcatgacctgttgatctacctgttgaaaccattattttaaaatatatttcccccaaaaatgctacttctgtatatttgtttttatcaaatataaatttacctagctcttttaagacacagatctcacccactgaattatgactaacatgaattttggaaattgtcctattttgatatgtcaggagagaacgttttactagcaggtttcattagccaaggtggaccagtgggtattttctgacattgcaaaagcagcttcaaagtgccactttcctttcctttccaggatgggtcaaataaaacaactctactccattctgtaagagattcaggcacagaaaggagaagatactgggctgctgacacattttctattcataaatgcttctgtttatagtagaaaatatgacattcaccatgagctgaccagccatcagttctgacatttatcagcgtcactttagaaacccatgtgggaaggcagaaaagcagaagggaacagaaactcacatgccacttgtagcagaatgcttgtgccatcctgactccccctctctgaaagcctgactgtgcaccatcctccttgataacaactaccaaccactgagcaagcctgcggtaggttatgtaggttctaggggaaggggatacaaagctatgttggacacttggaaatgcttagaatccagtcggggagccagcacaggaaacagaaacatctgaatgcatagccagctactggccctctacatgtatagccagctaataatgtgtgtgtgtgtgcatgcacacacacatgactagaagaggcattgtgcctggcagtgaaatgacagaggaaaggcatttattgtatgagggaaataaaagtagggaagtggtatcttaagagcaaaacatacagtctattccttccactccaaataattgaatgcttctgaatgtgcattccaaattttgagattaaatgaataaggccaacctgctgctgatggccacagtcagaaaggagggaagagaccacccaacccaggacaggaagtggagcagacttcatctggaacttgggaatgcctgcctccatgaaaaaaagtgtaagtgagatttccccctttttgatccatcttcaaccacttgataaattttcacaaaatcagtaatttcccaatgtggttgtgatggagcagggtagcttcctatttgcaagcattgggttaagcatctatgttttaaaagaattaaacatattaatataatactgtcccaatagtgcttacaaaacgtgtgtgggagacacactgctgagtttcaggaaataaacatcccttaacacaacacattgtaatcaaagaagcatattcacaaaacgttaaaactttttgccaacttcatgccagcaagcccagagggagagaacacgtatgctctttttcaatagagtatcacattatagacccattcaataaggtctgtatgagttcatttgtttccagataaagatttctgtgtgtggggagacttaacaacaaccacaaaaaaaggcttcgtggagaagggaacaaattagttggtgttttaaaagacagaagtatgtagacagtgaaagaggaatttgcaggaaatgtggtgggaagggtaccagtaaatcttaaactgagggaagagctcaggcgaaacctccagtgatcttcacaattctcaggagaatgcttatacatgatttgcacacaaaatattgaatttgaaaaaatcttatattgaattcccaagccacttgtagaatgcaatgtggcacactaatgtggtagaagggacataaaacaaacaaacaaactccctgcacaaatacccatgggaaaggaagaacagcctcacagaacttcaaaaagagaaaacaaagaaaaaaaatctcattttccaatgtatgcaaacatttattttctgagcaaagacaggattacaagtaggcagaatataagatttgaaaagcaaaaggaaaggttacatctccccaccacctaccacccacaaaccagttcatccacaggcaagctgatactgagactctacaactacatatttatacttttgacttaaatgtggccttctcttgaacagcaaataatcccaagatttacaaattaagccacatgaggcatttacacattaaagaaatgaatttttaagtctttcttaagacagagatttttgggtttggaagacagagaaagaatgagagtacttaggggaagatggcatgggttaggggtgacatttaggatgaagtgaagagacaagttatagtagcttaattcatagattaaaaggaagacctttataggaatctggttgtatagctaggagccaaacagccccttcctgatcaaaaatgttttcatctagtcttttacaatagaaatttgtttatcttgttttaaagtattctttatgtcatgcatgtaaataccaataaggtatttaaatattcccatattgacaagtatcgctttgcttctaatcttttttttttttttttttttttttgagatagggtctcactatattgcccaggctggtctcgaacttctgggctcaagctatcctcccactccacttcaccatcctgagtagctaggattataggcacaagccacctcacctggatttgcttccaatcattttctataagcaaaatgttacatgaaaatacttgtatttatatctttgtaattttgtgcaagaatttctaaaagaaaaaatcttagaaatcctagaaaaatcccaagtcaaaaggcacttgtatatataattttgaaaggtcttgtcatattgctctccatagaagatacaccaatgcatcttcccacctgcaatgtatagaacacctgtgtccccatattcttttttctttttttttttgagacgaagtcttgttcttgtcacccaggctagagtgcagtggcacgatcttggctcactacaacctccacctcccaggcagagaatcaagagaatcaagtgattgtcctgcctcagcctccccagtagctggattacaggcacctgccaccacgcccggccaattttcgtatttttagtagacacggggtttcaccatgttggtcaggctggtctcaaactcctgacctcaggtgatccgcctgcctcagctccaaaagtgctgggatttcaggcatgagccactgcacctgacctgtgtccccatattcttgccaacatagtgtattatcaaacttgttgatctttgccaatctgaaaagcaaaagtagtattcccttacagtttcaactgctttttacttgacttacagtttatctgggtagaaaatttagggatcacattctttacaggttgtggttattgcttcaaaagactctagcattttatattaatgtagagctaataaggatgacctgatttttcttcccctagaagggtctttaaccttttgcctgcttgaggagtcctttattatatttcaagtccagtagtgttaacagaatatgtcctttaaatatatagacttagatctccttttataaataagtcctcttgaattatattttcaaatacatttgaatcatccaccacttttctaaactctacaagctcatatttctttccgtagtcttctcatatctttcctgaactcttacatgaattttttgtgcttttattttatgaaagcagttgctttaagtcttattttaatttcattgatacatttaggaacaacttttattgttctgtgaaaaacgggtttgttttccagagattattctgtaactgccatttggtttttatgttctctttaaaaatgacaatacatactatgctagtttttgttgtttttaagaatatacctttttcatttgactaaaaatccttgaccagctctttccagaaaatgtggcaggggaacagagacatgttcaagtctaaaaagacagaattatatatgttatttcaattttacttcgccccagtctaccaaaatcaattctgcagagctgctcacaatgtgaaatttccttatgtcctctacctcactgatactctacctgcaaatgcagctcatctgtgaacatggcccataaagatttccctctctatttctcctcagaatcagactcagggaatttcccactaagagtccctagaccttggtcctgttgtaaagaaaaacgtgccgttttgcaataggttgtgccacttaagttagaaaggaatgctttgccaacattttctgagctctgaagttatgaccatttttttccagtgtctctctccactcacacctgtttcaccttgactgatttggggtgctcgcttcttattttgcaattcagagatttaagtagtctgctggtttcaaccaaaaatttaacttttttgctttttatttttctggttagtttttaataataattgaaagaaaaaaataagaaatggtcattttaatcagccaccataaaactaaattttttaatgtttctttaagggaatattttaactatattttgtttcttgtattgtaattggtctatttaggttatctacttttcttgagtcaatgttagtaatttacagttttctagaaactatgcatttcatctggattctagatttttttaaaatgtatatgctattttacatatatttcgttacatgtataatgattacatatatgataaaaatgatatatgttattctttttatttttaaaaagttctctttatttgtaattatatccccttatcttctttcttcaactaacttacaaagtagattggtacagattaccagatacttttcaatgttgtttaattcataattttttctttgcaaattctgatttacttgcattttacttattattttccttgatttagagtacaatactttatattaaactatgttgttttcaattaagcattttggggattgtgaaattaactctgaatattgcttttattgtatctcggagggattgatggttaatattctcactgtttgtttttaaaaagtttctaacaccaattttgattctctgtttattgtcactgttatgcattttttaatttctatggtaaatggatttaattggctattaattcattgttcttttctaaatttacgcatgtagtttaatgatatagtctgaattatatccatttggtattttgtttttaatttcttgagatgatgattaatgactaatgtctagtaaattatttcagatatttcattaatgttaaaaataatgtatattcttagcttaagtaacatatttctatgtttagtaaatatatgttgttcatcatgttttaaaaatttcctgtattcttagtttccaagaaaaaagcattaaagtgccatagaatattaaagagcaattaaaagaatgaagatctcttcatatgctggtaagaaaagtcttccatatgtttagtgttaaactaagtttggaacatctacaagtctttgcccaaatactctcagtgaagcttgcctggccatcttatttaaaattgcggcactcctcaccacacacacaaacttctcacccctcttcctctgctgtgcaatttcaccgcattgccatcttctaagatgttacatgatttgatatgtgatgcttattgctcatcatctgcttttctccactggaatggaaacttcacaagcccagtagtttttgcttcctttggtgaccaatgtgtcttggtgcctgtacatgtgggtgctcagtagttacaggttgaaaatattagtacgtgcattacggtaattcatgtaaaaacaaaaccacaagctactttggaaacaagtatatgcaaatgtatagaaaaagatctggcagtacactcaccaaattattaacagtgtttgatttgaaggtgtgactgaaaaatcaagacagctattaccttttatcagatatctttccattacctgctaaatttcatacttaaagagtattgtctttgtcattgcaatgttaaaatttttatttggaataataaaccattcagaaaacaattaaatattttgataacaaagagtaatagatgaggactatccttgacatacatgaaaatacactataagattccaatcattcaattagaatggtattgataagagaacagacctacaaatcatggaactaaacagatatctgatatagattacttagcatatgtaagaaagtaccacataacaaaagagacctttcaaatcagtgacaaatagaaggatataggaataactattagcttttggaaagacagggtaaaacaatgtaaattttcactttatatataaaaatatgagtagatttgtgaacatgaaacatagcactcagcacagaaaacatcataaataaaatttaaagtccaatattgtcttagaaaaaattttgaacaaacataaagacattaggttgagatccttattaaatcaaggtcactaatgaaaaacactaaaactctagtaaatagaccaagctcttaagtatgtagaactgattcaactataaaccaccagtttgtttctctgatttaatgggacaaaaggcacttgcagatggttactttatacagagtgactctatgaacaaagtctgtggaatccacaaacagcacacttgcagaattttgaaaaagctttgagattgtgggagtactgccctttacataaactgagacttcccacatttatttttattgtagtttaaacacaattcaaggatgctagttcaatgacaaatctgcacgaagtaaactgggacaagaggttattcaattgcccagaacaggaagaatttgtctctctatcatccctgtcaataataattagccctttctgaaaagggtgttgtagatacacagtcaaaatgatccttaaagggaggatataatttggcttacagaaatccattaccaacaaataactgcttgtggaggaaatatacaacaaagcaccacacttggaagtgataatcacagtaaatagcatccctagcctagattgggtcttatataagaaactatcatattgccaattaacaagtattttctcagtgtgatgacactttgaaatggctaaatacaaaattgggaggagaaaagaaattgcttagtctcctccctacccctcatcccctgcctccacagctccccaaactacacaagagaaaactcaataattctgtaagaatgattttcctggctcagttttataagagacttagaaataatacaacatcagtttataaaccagacagggcttggcctgctatgtcaacatagaaaatcaatccaggagtcccaaccctgctttgtggcctttagggctgcttcagaaatcaattcccaagaaggataaaaggtcactgccatggggctcaggaacacatgcctcaaattgccagctgcagagctcaattcccccagggacttggcaatttcggctctaaatgtggattcacaagggagagccatcctgaccaagcacatatgctcttttgaggtagtggccattttcatgccgacatttttgaggccctatcatgggtcaggactgagctgaggctttccatgcattgcctcactgaatctccacaataactcctgtatgagtccgttttcgcactgctgtaaagaactgcccaaaaccgggtaatttataaaggaaagaggtttaattgactcacagttttgcacagctggagaggcttcaggaaacttacaatcatggcggaaggcgaagaggaagcaaagactttcttcccatggtggaagaaaagagacagcgtgtatgtcagtgcaggaaaaactaccatttataaaactatcagatctcatgagaatttgctcactatcacaagaacacatggggaaaccatatctataacccaatcacttcccaccaggtctctctctaaacatctggggattacaattcaagaggagatgtgggtgttgacacaaaccctaaccatatcagctcttgagtagatgctatcattatcatcatcccccttcacagaagggcacagagggacttagagcatgtggctggccaaggtactaatctacccagtgaagtcagaccttttaacctttttctggtatgtttgtattcattcactggggctgccttaacaaagtaccaccgattgggtggcttattcaacagaaatttattttctcacatttttagaggctagaagtccaagatcaaggtggcgtcttctgagacttctctatctggcttgtttttttcctttgtcttcatatgatcttccctctgtacctgtctgcttcctaatctcttcttacaaggacaccagtcctattggattagggcccactttaatgacctcatttaaccttaattgcttccataaaggtcctacatccaaatgcagtcacgttctatagtattgagggttatcactttaacatatgagttggggggagcacaactcagtccatcacattctctattattgtaattgttcagatccatttatctcttataaaccaatgatcaaaacctgtacatccaactctctgcccatcccataagaaatacctggttgtggctggagaaagagctacaatatactggctggtctcacttggcatgttcttgacattcaggataggcggagtgacccagcaatcatatagacaccatccattccagtgacactcaaacttcagcgtgcatcagaatccctgcaaggcttgctaagacacagactgctgcgcctacctcagagttcctgattcatcaagctggaagtaaggcctgagatttttgcattactaacaagtcttcaggtgataccaatgctgctgatctggagactgcctttgagagccactattctatctctttcccaatcaactgtcctttctcacctcccttttaaatctccagcacctgctccctcatgttcattctcaatgcacaatctttttttctccttcactgacagaggtgaaacaattaaaagagaatttccccagtctctcactactgcacctgctcaccctcccacaagcacgtgtactcactgtgcttttcttgctgttttgaaaggtgaattgtctgtggtctttctagagccaatctcttcacatgtgcaccagattccaagccctgcggcccactcaagggcatccctgcatgtcttctcccatctcttaccttgtcaactctttccactttttgagtcatcctcctcagcacaaaagattgttactcatttatcttaaaaagcaaaaaaactaagccaacaaaaacaagaaaaaacagaaataaaaccttttactggaccctctctccctaccaggtatgactccatttctctttgcctttgcagaaaaacatttagaaagggggtctgtattaattctatccagttcctctcctctcattctctcacagacccactgaaatcaggtcttaactctcaacaaaattgctcttactgaggtctcagataaacttcaggttgctaaatctcatggctcacatttggtcctctcacattttacgccccttgacagagatgacaccactccttgatactttttttttttttttttttttttggcttgtaaggctttctaattcactggttgctagtctcagaactttgtgaatgatttatctttgcttatacctcttagtcctggactgacttgccccagattgtagtttctttttttatccactctccttcctttggggatctcatccagtctccctctgtatgccctttgttgccaaatttacatctccagccctggatgctcctttgcctcagactccaaaactatattcaaagtctctcatttagatcattcaaacttttcaagagtgactcctgatcttctcccaaatatctgagctgctcaaagctttccatctcagtagatgaaaaattcacccctctagtgcttaggtcaaaaatctttgagtcacccttgtttcctctctttattactccccccactgcacatccgattcaccaggaagtcttcctgtgtttaccctaaacataattcagagaccaattactcctcaccgcctccatggctatcactttcgtcagacttgctacattttagcaatcgtcttataactgttttcctattcccacccttgcctccttccattctattgcccacaaagaaacataagtgatccttttgaaacataagtcagatcacggcatttctttcccaaaaagaaatgcaagtgtctaaattcttcgcctacctcagggtaaaagtccaagttcttatatggcctttaaagacctctgtgtactctcctcctccctccattagttctctgatcttcccttcttcttttcttcctcatcctactctgctccagccacgcagtctttctggctatttcttgaacatagtaaacatgatccctcctctgagctttgagttgtttcctttgcctgggaaattccatctggagacttccgggcttgctcacctatataggcaagtctgtacatgagacctgctctgaccactcaatttaaaatggcagcaaaatccttcctggcaccccacctttaaaatggcaacaaaagccttcctggcacctttcctttctagctttggacctattacataatctatgtatcttttgtgttatcatctgccttccccgccagtatgtaaactccacaaaggttgagatttttgtttggttcactgatgtatcccaaggacacagttcagtatctaacttgcagtggaaactcaccaagtatttatcaaattatttgataaatgaatgtgatgataaatgaatgtgactgtaaaatgatactttatagtcactggagaaatcagtctctgacatccccaggaacaaaatcaacattctttggaatagtcattgataaagggttcataactttttgtgccatggacttctttggcagtctgtagaagcctatgaaccccttcacagattagtatttttaaatgtacaaaataaaatcaataaactacaaatgtagtaaattattttatcagaacatttttaaaattataaaacaaatttgtagctaatagtaatacacatacttcgttatccattaattgacaacatctggtagtggttctaataacgaccataattttgaagtactgatgtctagactgatatttcaagatgtctgtaataactctaacgtgatacgaatgtatctgtaatttccactgtgaataaagtcactggtactgccaatagcaccatggtttcttgcctatattcataaatgaaggaaatgttaaattttagctagttaaaaaaaaaaaatgaaaatgaggttgtattttctacagatacttaaatgaatgctttggaaacacttgtaaggagtagaaataaaagcagaaagactttcccctttcttactcccccagaaggtgctactgaattgttgcagataaggaaattgtaagataattgaaaaaatgataaaaatctggaagaattctgtgccaagactgtttttgctttcgcaagtgtctaaattcttgttctactttaatagaatcaaatctgcaaattatcagagtgatgatgtacatggttcatataaagcagacaatgtggaactccaagtatctgaacaatcagatcaaaatacccagactacatatcaagaaagcaggctgagtgtgatggttcatgcctgttatcccagcactttgggaggctgaggcaggaggattgcttaggaactcaagaccggcccaggcaacatagcaagacccttctctacaataagaaagaaaagaaaaaaaatagaaaagaaaagaaaaaaacagaaaaagaaagagctgggcatggtgtcacttgcctgtaatcctagctactagggaggctgaggcaggaggatcccttgaccgcaggagtttgaggttgttgtgagctatgattgtgccagtacgcttcaatccaggcaacagagcgagaccctatcttttaaaaaaataaaatagaaagcagtgcctccatgtgcttcaatgtgcatttatgtatttaagataaaataaactttttatgatgtatatttataatttcctatcatttttcactcacagttttgtggttttctctttcttttcttttctttccctttcttttccttccctttatttttcttcttccttttttttttattcaccaactacccaccttccctaattcgtaggttagaaggatttctctacagttctttctcttttttccaatctcttctggatgtttctttgtctcaaactacatagacattgtggaaatcagtatcttcatttcaagtctaggtgggtcaaatttgattctcttgtattttcactcttaaaatagcatcttgaactttcacctgtgatccatctataaggatcaaatgtaaggacttcaagagggcatctgcccaataatttctgtatacccagtacagcaaacagggtggtattgttgatgtgtactcagtgcatacaatagtatagtagtgttgtatatgctttgcagagagtagcattattgttgtatcagcacataggacaggacagttttattgcaacataaccaaaacataggttaaatgttaatgttgttgtacacccagtgcatagaacaacataaaattgttgttatatgttcaatgcaaaccacagagtagaatgctcaatttttgttgaatgacataaatgaattaaatggacacagcatcacctacatgcctcacctacaaaggcctaacttgtaatgggattactattgttgttttaataaattaagcaacgaatacagtttcaaaaagtacttagctttatttttcaacacagtaaatatgaatataacccatatcagtaaaagttgtttggggtcttcaatgatatcttaagactataaagaggtcctgacaccaaaagagggagaagcaccgcaatcttgcatgctcctggctcctgagaggttattgcagtctgccatactattgtatttccagtacttacatggtgttttggcaaaacctgagcatgtgttgtcaagtggctgatgaggatgtgattctgagaaaggcaccacgagataaaagatatgaatctcagctgggcgcggtggcccacacctataatcccaacacttcaggaggctgaggcgggcagatcatgaggtcaggagatcgagaccatcctggctaacacagtgaaaccccgtctctactaaaaatacaaaaaaaaaaatagctgggcatggtgacaggcacctgtactcccagctactggggaggctgaggcaggagaattgcttgaacccaggaggcagaggttgcagtgagccaagatcatgccactgcactccagactgggtgacagagtgagactccaactcaaaaaaaaaagaaagacacgaatctctttaacgtgagtaaggtttagatttttatcctcgtagaagaaacagcaacgcagagaatagacaaatctaccaaggtctcaattcctacaagttcccccagctgctgagtgtgaagccccacgaggttctttgaaaagtgttcctttgccagtctaaactgttctgggacttcattatagcaacgcctgctcaccacaggcaaggaaccagcaatctgatgaaggatttattgaaaatgtgggtaaatcagagtttttgttcccatgtgaatgattcccccggcaggcttgagctttagaagctctataaatacttactaagtaattaattgattgactaaagaaataaatgaaaaaaataacaataattataaatcgaggaaatgtaaaatatgtattattgtcacaatggatgaaaatatcccaaaagagatcatttggttgtgagttaggttttaaagtatacgcaatattagaaatgaataattgaagatagtttcaataattttaaaaactactgcccaatggtaaaagatataaaagattatgtaatttacaaggcagatgtcctatatctcttgaattattttagactgggacacaaaaagcccaggcagtcaagatgatattaaatgattcaaaaatagcattatttcaattaaacaaataaatgcccacaagacctacacaacaagctgaaaaagttaggtgcttatcacatcaggattctgtactaccttcctttaggaaaaaaatattattgaaatactaaattgtattgaaacattgtttttaaaagaattaggcaatgcatggaacatacttttgagtctttttccctgagtttcaaaacacaattcagttgtttcctttccaagaagtcaaacaaatattgttatttacaaactaggcaaatagcatcaagagaagaaaatatatttctttttactttttctgccactgaagatctactaacactagcagagaagaccattaatacataataaggccacattcaatgccccatgatttttattattctacatcaacttaaacaggggaattctaattcttttgactatgcacttcctctttttccattttcttttttttttaattaatgttaaaactttcagagctacaatattgcaatctattctttcaaagcactatttgcctattaaaagaaattccaccaagttcagacattaccttagcaatacagtagaatatttctctactaataaaaaaatcaactcctgcagttttaaccaacacctatgtgtaaatagtcttcttatttatatcacatttacaacatttccgctactcagttaaggtgcataagagcagaaactgtgacttctcagcactaggacctagccagatagtcattgccctgttcaaaataagtttaacaactgttaaatgacaagtttagatggtgccatctgaatcctccataagcactgcaaattcagcatttcattctcccattcttacttatctgtgttgattgcttcaccacctacccatttgttaaggtcaaaaatgttggcttcatcaatggctgtacactctcctccctttgaaattcttaccctattatttgcctagtcctacagattctctgcgaattctctattactacacaaatttagctttcattattactcatcaaaatattacttttgtctctttcattgtcaccaatagaatgccttctctaccttctccaacctatttcattataaagctagttgtgcttgctttctaaaaagtggatatgcttttgctttcctcccagtttcccctctgtttagatttttaatggctcccgattttctgtattatctaaatgctcagcatgtcctactggacttcactactacctttaaataacagctccccgaccagctcttgcctagactctccttgtgccttatatgaacaacaaatgtctctgtcttaagttggtttccccagaagcagattctgagacaaagatttgagtaccggtgctatattatttgggaaatgatcccgggaaacaacaaatgtctggagagagataaagagaaggaaagagaaccaataatttgtgccttgtcaagcaggtgttagaggtagggcaactgagttcaatctcattggggagtcctaaaagataatgaggaacactcttccttattatccaaccccaacccctcctgcctccaagggcaaggaaggtagagtgtgtattctccaatccatttgtcactggccaagaactgctactgcatacattcatcacttaccatttccagcctgcccaataaaaagaaagtctcaggtagagagttacaggtgattctagcagaatgccagaatgacatgggtaggcattgatgcaggactgattttatgcacataccacacagcctcacgtatacactattgttgtacataaactgttacttgtgtaggaactctcattgttgttgttccagtgaaattctactcaatctttaagcccaatgtcaaaagtcactctgattccatttctgaggaagaattaatgattcctcctgtacttccataatacttccttggagattaagatttcaacttgtactcatggttccacctttgtatcactatgcaatgcagtaatctccatttgacaaatcaggaaacagtcagaaagatcatgccagaaattacatgattcctaaaagttggagtgtggaactccaacctagccctcttaaaaatctactttgcccaataaatcagatatcctcaacctgaactgactatgtatctgctatattaaataattaaagaccaactggcctaaataaatgccctgctattcagagaaccagcactgcaatgtggaacagatctacctgccttataagcaagaagtccagtttctccttcttcaggctcttcactcctctggactgttcataatcatgagggtttcacaaaccaaaacaagaaccttacaaacttccacactcaagcctgcaaagacccagtatctcaagtaagcacttccattgggtcttgttgcagcatggtggacaatggaatgtggccccacagtctattagtcaatattggtctcctgctatggtcatctcactgctctagatgctttccagctgttcttcaaggaagcacactgaagcagtaagtgctcagtcctttcagtctcctacacagtcaactcagggtgttcttagttccaggcagcaggacagaatggttcaagcacctgtcacttcgtatgagtagtgctctttttccttcccttcctttgcttcttatccccatctcttgagccatcatgtcaatatcacactggttgttctttttaactctatttacaggtatgaatctcagcccacaaattcaggtgagcaagaaatctacagtctttacattataaaactttattttttgttgtaagagccgcctttctcgcatgactagtgggaaacttaaactcagtcccattcatgattttctgtcccttagtgggttctcagagagtgccttgggattaaggagtgggatctctcttatccttaagcatctgtccacacacagacagctactgagacaccctctgtctttctccacacggcccctctggcatgctggctcactcctgccaggcacacttgggacataaaacctttctctgagtttgtccatggaaaccatcttctcaaataccccatacagtcatttcctctcaggggttttccaacactcaaccttacttctgttgactgaggccttggtctctaccacacagggacttttacaaactatcttgctttctccttgcaagtggagacacatctctctagtcttacaggctttagtccagctctccctactgcttctggccaagatactctgtccagcctgccaattctctcttttctgtggggcttttaaaggacagataaactaactaataaaaagccagaaatattggagtgccatttgttctttctgctttttaacaccccttccctgagttgaatgagaggaagagatccctgagttgaatgagaggaagagaatcagagattcagggagaaaacaattctagattaatattacaaatgatttctccagatatacctagaaacacaaagaaataattatagccatttcatcccattggggttgttaactctgtccttactctacttaagctaatatcctaaatccttgtgcactaatatcctctttatatcccacttcctctccaaaatatatcctctttccctgctcctgttcttgtaggagtaattccagaaggccctgaccatcgctccccttttagggaggaattgctccctaaaagtccaaggtggttttctggctacaaatgtattctctaatgggatagtctacatgaaacaacagaaaacaaaattaaatgtgtcaattgatgtaacttgataaaccttaatatcaacatatttgctaccaaaggatgtggaaaaaggagcaggtggagattaaccagtgattaggaaacaaaattctgagtcagaacctggtcttctgtttcaaactttatcccttcatcataaaatacatgcatgtttctagataacgcaaccctttactcttttccaaaaggggaaaaatatctctgtgagtgtctattcctaaattctaacaagtgtcatcttagaaaacaaacaaaaaaaaattagaaaattgctgaacaatcctgctagctgctattcagttatgaagatcatagtcattctgttcgtgagatactctagagatgttattcagaggctgcttaggagaaaaaaaagaaaaatgcaaactgttagatctcagttaaataactgagtttattgcaatttaagctaatagttattcagtattcagtcaactatttggtgcaaacaaataaatattcttccacttgttagtccctaggggctttcttaatcctatctgaatttactttctgtgaatttctgagtaatcagaagttataggttggatacatcttgtgctagggacacccatggtgtaactgcttcattttttcttttcatttcaaaggaaatggtccatccaaagtgaaaattgttgtgttttatttttttttttggtggtagagtatattttcctctttgttggtgttgttattgttgctgttgttttaatcagatagttatttcaaacagaagcaatcaagttccttttttcactgccatctccctctacccttcctactcaatccatgctgttaagaaaatatccttgttagtaatgtgacataaagcagccttaaaaatccataattcagctgggtctagtggcttgcacctgtaatcacagcattttgggaggctgaggtgggaggatcgattgagctcaggaattcaaggctgctgtgagccatgatcacaccactgcacttcagcctgggtgacagagccaagaccctgccataaaaaaaaaaaaaaagattcaggcccggtttggtggctcacacctgtaatcccagcactttgggaggcctaggcaggcggatcacctgaggtcagagttcgagaccagcctggccaacatggtgaaacccccatctctactaaaaatacaaaaatgaggccgggcgcagtggctcacacctgtaatcccagcatcccagcactttgggaggccgaggcaggcagatcacctgaggttgggagttcgagaccagcctgaccaacatgtagaaaccctgtctctactgaaaatataaaattagccatgcgtggtggcacatgcctgtaatcccagctactagggaggctgaggcaggagaattgcttgaacctgggaggcagaggttgcagtgagccaagatctcgccattgcaccccagcctgggcgacagagtgaggttctatctcaaaaaaaaaaaaaaaaaaagattaataattatttttcatcagttcattcagtcttgtaattaattcttgctgtgatctgtattagcaatttcacaaacccatcagtttcttcattcgagttttggaattttttttttttttttgacagagtttcactcttgttgcccaggctggagtgcaacgacagaatctcagctcactgcaacctccgcctcccgggtttaagcgattctcctgcctcagactcctgagtagctgggattacaggcatatgctaccacgcccagctaatttttttgtgtttttttttttttttttagtagagacgggttttctccatgttgatcaggctggtctcgaactcccgacctcaggtgatccgcccacctcggcctcccagagtgctgggattacaggcttgagccactgtgcctggccgagttttggaaatttagttcaatagtgtgaactcaaagttattagaaacccgtacttgtcagacttcattctttccatgaagctccttgaagacataactctctgggattataattgcctgcaagaagctttcagaaagacattagactaaagcaattaagtgtggacatgaagacttcaagtgaccatggccaaaacctggtctgagtccatggtaatgacgacataattgacaagaatgttatttctgaaccaaaattgactgataccatttataccaagacacatcagatttttaaatatgttatacaatttttcagtatattaataacatatccatataaatatacctcaaggtgaaatatttcttattttgccaatccttctcttataatttattttatgtatttcttttttttttttttttgagatggagtctcgctctgtcacccaggctggagtacagtggcgcaatctcggctcactgcaagctccgcctcccaggttcatgccattctcctgcctcagcctccagagtagctgggactacaggcgcctgccaccacgcccagctaattttttgtatttttagtagagatggggtttcaccgtgttagccaggatggtctcaaactcctgacctcgtgatccgcctgcctcggcctcccaaagagctgggattacaggcatgagacactgtgcctggccttattttttattttatatttaaaatttttaaattttttggccgggtgcagtggctcattcctgtaatcccagcactttgggaggccgaggtgggtggatcacctgaggtcaggacttcaagaccagcctggccaacatggtgaaacccggtctctactaaaagtacaaaaattagccaggcaggatggccggcgcctgtaatcccatctactcaggaggctgaagcgggagaatcacttgaacctgggaggcggagcttgcagtgagccgagatggcgccactgcactccagcctggcccacaagagccagactccgtctcaaaaaaaataaaaataaaaataaaataaaattttttttgtagatacaggagtctcgatattttgcccagactggtctcaaactcctgggctcaagcaatcctcctgccttggcgtcccttgggattacaggcattagccactgtgcccagcctcatataatttaatatatcagataagcccagttgatttaatatttctttttttgtagatcctttgagaggttcaggggtcctctggaacatcctaaagttagtttgaggtcaaaaatacttaattttgatttttttttttttttgagatagggtcttactctgtcaccctggctggagtgcatggacacaatcatatctcactgcactctcaaactcttgaagcaagtgattgtcccaccttagcctccagagtagctgggtctacaggcatgtgccaccacgtccagctaattttgtttattttttgtagagatgggatcttgttatgttgcccaagtgggtctcaaactcctgggctcaagcaatcctcctgcctcagcctcccaaagtgttgggaattcaggtgtgcgccactgtgtctgccttaattttgatttttgaaaagtttgtcaaatatcaaagttttaaaacgcttgatcaaagtaggatcacaagtcactgtgaaataaaaccaaagtgagaaaatatttgaaagacacaaaacacaataaatactctttttttttttgagagggagtcttgctctgctgcccatgctggagtgcagtggtgtgatctcagctcactgcaacctctgcctcctgggtttaagcaattctcctgcctcagcctcccaagtagctgggattacaggtgctcgccaccataccggctaatttttgtattttaaggagagacagagtttcaccatgttggccaggctggtcttgaactcttgacgtcaggtgatctcactgtcttgccctcccaaagtgctgggattacaggcgtgagccaccgtgcctggtcaatttttttttttttttttttttgagacggagtctcgctctgtcacccaggctggagtgcagtggtgtgatctcggctcactgcaagctccaccccccgggttcacgccattctcctgcctcagcctcccgagtagctgggactacaggcgcctgccaccacgcccagctaatttttttgtatttttaatagagacagggtttcaccgtgtttgccaggatggtctcgatctcctgacctcatgatccgcctgcctcagcctcccaaagtgctgggattacaggcgtgagccaccgcgcccagccctggccaatgttcttgatgaaacagattctctgtttcctaggccagttacctaaaaggtaaagaaaaatcttttacaattttcttgtaaagggtagatcaatggtccacaaaaactctgttgttgcaacacaggggcccaaattgcggccttgtatccatcagtgtgcttttgatattaacgctcagtttttagcctaggcaacatgggaagacctcaccgctactaaaagtaaaaattagccaggtgtggtggtgcacacctgtagtcctgtctacttgggaggctgaagtgggagaatcacttgagcccaggagattaaagctacagtgagttatgatcatgccactgcactccagcctgggtgacagagtgagaccctgcctcaaaaaaagcttcaattttaggccaggcgcagtggctcaggcctgtaatcccagcactttgggaggctgaggcgggcagatcacgaggtcaggagttcgagaccagcctgaccaacatggtgagacccccgtctctactaaaaatacaaaaattagccgggtgtggtggcacacacccgtgatcccagctactcaggaggccgaggcaggagaattgcttgaaccagggaggtggaagttgcagtgagtcgagatagagccacttcactccagcctgggtgacagagtgaaactatctcagaaaaagtaaataaataaaataaataaaggaaaagaaagttcaatttttagaaaatcttataaatatttatggctttttttttttgagatagagtttccctcttgtcacccaggctggtgtgcagtggcatgatctcggctcactgcaacctccacctcctggattcaagcgattctcctgcctcagccttgtgagtagctgggattacaggcgcctatcaccatgcccagctaactttttgtatttttagtagagatgtggtttcgccatgttgagcaggctggtctcgaactcctgacctcaggtgatcagctcgcctcagcctcccaaagtgctgggattacaggcatgagccaccacgcctggccaaaaatcttataaataatccccttctaatttcggccagcttaatcacacaccaaattcctttcatgagattaatcttccacaacttctacacttccttaaatctttgattttgtcctatacttctttttttatattagcaatctactttaggacagaaatttactttcctttcctcttgattttgaccaaagtcctctcttatgcaaaatgaaaaattactcttttttcaactttctttaccaaaaatacatcctcatatttataactttttttcacatctctcctacttactggccttcttcccaccttgtttctatttccttcctaaatccatattttgaaacaatctttaaataacccccaacttaaacaaaattgctcttatttaacaaaaaacttatctcaaaaaacctagcacggtcaccaagcgtgctttgcttttctttctctctcttttttttttttttggaggcggattctcgctctgtcagccatgccggagtgtaaatggcgcgatcttggctcactgcaacctccgcctcccaggttttgagagattctcctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcaacaagaactgcatgctgggttctggacagaaatagagttataattaagcattcatcaggctgcattttggcccacttccttgttgctaaaagtcaggtggcactagttcctgaccattgcataccattgttcctgtagataggatttctgacattagagtcagaagactgttttaagaatttatttggggatcttctggggctgtatcacagggggaaaagtgaaattaaaaaaaaaaaaaacacaatcaatttgggctgggcgcggtggctcacacctgtaattccagcactttgggaggctgaggtggagggatctcttgagcccaagagttagagaccagcctggccaacatagtgcaactccatctctaccaaacaaaatataaaaattagccaggcatggtggtgagtgcctgtattcccagctccagaggctgaggtgggaggatcacttgagcccaggagttggaggctgcagtgagatatgatccagctactgcactctagccagggcaacagagcaagaccccaactcaaaaagaaaaaaaaaaggaatttagattaaaaaagaaaaagggctcgagtttgaatgcagtggctcaagcctataatcccagcactctaagaggctgaggtaggaagatcgcttgagctcaggagtgccaggctgcagtgagccgtgatcatatcactgcactctagcctggacaacagagtgagaccttgtctctaaaacaaaacaaaacaaaacaaaacaaaacttgagaatgggccagacgcggtggctcacgcctgtaatcccagcactttgggaggccaaggcgggtggatcatgaggtcaggagttcaagaccagcctggccaagatggtgaaacctcgtctctactaaaaatacaaaaattacagcgtacctgtaatcccagctactcgggaggctgaggcaggagaatcgcttgaacctggggggcggaggttgcagtgagccgagatcgtgccactgcactccagcctgggtgacagagcgagactccatctcaaaaaaaaaaaaacaaaaacttgagaatgatagtgttacaggaaaggggtccctacccagaccccaagtgagggttcttggatctcacgcaagaaagaattcagggcgagtgcataaagtgaacgcaagtttattaagacagtagaggaatgaaagaatgaccattccatagacagagcagccccgagggtggctggttacccatttttatgattatttcttgatgatatgctaaacaaggggtggattattcatgcctcccctttttagaccacatagggtaacttcctgacgttgccatggcatttgtaaactgtcatgaagctggtgggagtgtagcagtgaggacgaccagaggtcactctcgtcgccatcttggtcttggtgggttttaaccggcttcttcactgcaacctgttttatttatttatttatttatttatttatttatttatttatatattttttgaaacggagtctcgctctgtcacgcaggctggagtgcagtaccgcgatctcggctcactgcaagctccgcctcccgggttcacgccattgtcctgcctcagcctcccgagtagctgggactgcaggtgcccgccaccatatccaactaattttttgtatttttagtagagacgggatttcaccgtgttagccaggatggtctcgatctcctgaccttgtgatccgctcgcctcagcctcccaaagtgctgggattacaggcgtgagccaccgtgcccggccatcactgcaacctgttttatcagcaaggtctttatgacctgtatcttgtgccaacctcccatctcatcctgtgacttagaatgcctttaccatctgggaatgcagcccaataggtctcagcctcattttatccagcccctattcaaaatggagttgctctggttcacccgcctctgacaatagtagaagttaaaaaaaaaaaataacttctttaactccactccaggtggcatttcttagtgcctctgaaggttctgatctagaaccagcccccagctcacccagagcaaggaaagatcatgaaaacccaagcagaagcaagacactgggttccagcatcaatgctaagggctagaacattttctgatgttttgcttggaaaggcagaatttggttgtctagtgcgtccactaattggcctccatctgacaccctggagggatgggctgattagaagccacagctgctttgctcattatttctgatgaatggacatcacctggcgtctccggtgatggcgccagctcaggacccaggtgtgacctgcacaacaaagaaaagcaagatagctttgcagccaacatggtgaaaccccatctctattaaaaatacaaaaaaaaaaaaattagccggacgtggtggcgggcgcctgtaatcccagctactcagtaggctgaggcaggagaatcgcttaaatctaggaggcagaggttgcagtgagccaagatcatgccactgcactccagccttggcgacacagagagactctgtctcaaaaaaaaaaaaaaaaaaaaaaagatggctttacagccctgaggagtaaaccagtcttccccaaataattatcttatgtaagtcccagccccttggaacatgttttgaaagggctcacccatctgggcaggtgactcacgcctgtaatccctgcactttgggaggctgaggcaggcggatcacctgaggtcagaagttcaagaccagcctggccaacatggcgaaacccatctctactaaaaatacaaaaattagccaggcatggtgggacacgcctgtagtctcagctacttgggaggctgaggcaggagaatcacttgaatatgggaggtggaagttgcagtgagccgggatcataccattgcactctagcttgggcaagaagagtgaaaccccatctcaaaaacaaaagaaaaggctcacccttttcactggttcccttgtggcaaatctaaaataaggtacgtgtgctcgccgttcattcatctgaaaagttctaacagtttgcaaataccctctacccataccccacccccacgtgttgtccttttttttttttttttttatttgagacagagtctcactctgttgcccaggctggagtgcagtggcgcaatctcggctcactgcaagctctgcctcccgggttcacgccattctcctgcctcagcctcccaagtagctgggactacaggcgcccgccaccatgcccggctaattttattttattttatttttgtatttttagtagagacggggtttctccatgttagccaggatggtcttgatctcctgaccttgtgatccgcccgcctcggcctcccaaagtgctaggattacaggcatgagacaccgcacccggcccttttttttttaagagacaagatgtcaccctgtcacccaggctggaatgcagtggtgtcgtcatagctcactgcagcctggaccccctgggctcaagtgatcctcctgcctcagtctcccaagtagctgggaccacaggggtgtcccaccacacccagctaatttttttattttttgtagagatggggtcttgtcttgtcacccaggctggtcttaaacttctgagctcaagcgatcctcccacttggacctagccaggtgctgggattatgggtattagagtttaaatttctttgctcaacaccactccccattttgtggccaacagtcacattctttcttgggccacgtcattcattttcagttgcttcagagcactggtggccccttgggtgtgttgaacaaaccccagcctttgaggagttcaaaaaaaaaaaaaaaaagacaccatctctaggcggaaaatttcagacaaagaacccctgccaggaatatttcctgccgctgctcctgccactgccccttaggctgtggacctttatgcaagaacgcaagtggcaaactgccctactgtgtatgttgtggggagtgggggtactgccagagaggagagagccctattttattttattttattttattttaaagacagagtctcactctgttgcccaggctggagtgcaatggcacgatctcggctcactgcaacctctgccccctgggttcaagagattctcctccctcagcctccccagtagctgggattacaggcgcatgccaccacgcctggctaatttttgtatttttagtggagacggggtttccccatgttggccaaactcctgaccttatgtgatcctcccaccttggcctcccaaagtgctgggattagaggcatgagccactgcgcccagctgacagccctctctaaatctttaaaaattcagtcaggcgtggtggctcatgcctgtaatctcagcactttaggaggctgaggcaagaggaatgtgtgagcccaggagtttgagaccaacttgggcaatatggtgagaccctatcttgacagaaaatacaaaaatcagcctggcatggtggtgcacgcttgtagtcccagctactcaggaggctgaggcaggaagatcacttgaacccaggaggtcgaggctgcagtgagctatgatcacgccactgtactccagcctgggagacactgtctcaaaaaataaataaataaaatctttaacaattcttcagcttatccccctaccttctggggcttcttgggtctcttcccagaaactttcttcgtctgtaagcccgtttattgtatgcaattgtttaaaaaacacaaatgggtgcatattctcatattctctaccctctattttgaacgttccttttttttctttttttcagaccgagtctcagtctgtcacccaggctagtgcaatggtgcaattttggctcactacaccctctgcctcccagattcaagcgattctcctgcctcagcctcccgagtaggtggattacaggtgtgcaccgctgcacccagctaatttttgtatttttagtagagacgaggtttcaccatgttggccagactggtcttgaactcctgatctcaggtgatccacctgcctccgcctcccaaagtgctgggattataggcatgagccgccttgcctggctcaaagttcctttttggtttaacaatagatctaggccactgtgagtcttcctcattccttctagggctacctagtgttccggggttatttaaccagccccctcctaccaggcagttcttttgtctctggccctttgctacgtatattagtttaaagttcactttgcaagtggccaaggctgtttccctcatttccaggttcccagggggcagacatcctgctgcaatttcagaagtcagcacactcttctctctcctgtctaaaatacaaaagtccatgccccccactctccctcttgatactgtcctattttacttcttttcacaaccagaactctttatttttcccaaataaaaatagtccgtcttttcagattttaaaaatggaactctggccggatgcggtggccctcacctgtaatcccagcactttggaaggctgcagtgggcagattacctgaggtcaggagtttgagatcagcctggctgacatggtgaaactctgtctctactaaaaatacaaaaattagcccggatgcggtggctcacatctgtaatcccagtactttgggagaccgaggtgggcagatcacgaggtcaggagttcaagaccagcctggccaacatggtgaaaccctgtctctactaaaatacaaaaattagctgggcatggtggcatccgcctgtaatcacagttactcggcaggctgaggaagaattgcttgaacctgggaggcggagtttgcagtgagctgagattgtgccattgcactccagcctgggcgacagagcaagactccatctcaaaaatatatatatatacaaaaattagctgagtgtggtggtgcatgcctgtaatcccagctactcgggaggtgaggcaggagaatcacttgaacctgggaggcggaggttgcagtgagccgagattgtgccatttcactccagcctggacaacaagagcaaaactcgtctcaaaaaaaaaaaaaaaaaaggaaaataaaaatccctgataaaggatcaatgaccttaggataatgtcattccaggtaagtatctttaactgggtacttggtcctccaagattcagaggaccttgatccccctgaaactgtatacataatattcaacatacatagtatgtgcacacatgtgcaaacactcacattatctaaaattcatcataatcttaccccggcttctccccatactcctcagatcctgctatagcctagtgcattttctccttcctcactcccttccctccatgtgtcctctgccctggccaccaggaactttgtgctgcctccggagtgcatgaggcactttcacatctctcttgctttacaagagcttccctatgctccaactggcaaatttctctatggactgaaaaacccacatagcctttatctgtcttgtgatgtcttctccccaccctcaagttaggcatacccttctatgccctcctttatccaaacattttccccactatatcgtaattgtgtgtttaagtgccggactttccaactagatacaaagctttcccaggaaagaaatccttttcttttcttctttctttcttttcttttcttttctttctttttttttttttttttttgagacagattcccactgtgtcgtccaggctggagtgcagtggcacaatcttggctcagtgcaacctccacctccagggttcaagtgattctcttgcctcagtcttccaagtagctgggattacaggcacgcgccaccacacccagttaattattattattattattttttttttttgtttttgagacggagtctcgctctgtcacccaggctggagtgcagtggcacaatcccggctcactgcaagctccgcctcccgggttcacgccattctcctgcctcagcctcccgagtagctgggactacaggagcccaccactacgcccggctaattttttttttttttttttttgtaattttagtagagacggggtttcacagtggtctcgatctcctgccctcgtgatccgcccgcctcggcctcccagagtgctgggattacaggcgtgagccactgcgcccggcctccacacccagttaatttttgtatttttagtagagacggggtttcaccatgttggccaggatggtctcaatctcttgaccttgtgatctggctgcctcggcctcccaaagtgctgggattacaggcgtgagccaccgctcccggcgagaaaccttttctttttcttttttcttcttcttcgtctttttttttttttcttttgagagggattcctgttccgtcgcccaggctggagtgcaatggcgcgatcttggctcactacagcctctgcctcccgggtttaagcgattctcttgcctcagcctcccgagtagctgggattacaggcacgagccaccacgcccggctagtttttttttggtatttttagtagagacggggtttcgccatgatggccaggctggtctggaactcccgacctcaggtgatccgcccacctctgcctctcaaagtgcagggattacaggcatgagccactgcgcccagccaagaaaccatttctgattcacctattcactcccgcactcccactacacagtagctaaataaataaataaatattaaaaataaataggaaagaaagagagaaaaaaagaaaagaaaaagacaaaaatttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcgggggggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggaggagtttgcttcctaactctgcttccctgctttcctgtggggggtcttcccaggagttcctggggccctgggtcactttttggggtgcgtaaggggtgccgaaaaagatttagaactcggttcccttttctggagctgcgctttcatcgcgactgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtagactttctggtagccaccatccgggcttaagccatccggatagcaagccctctgattcggttgctctgtgaccttaaatatttaccctctctggtgtgttgatttcctggatgcttagctgccagactggcttatgaagtccttttagagttttctgtaaaagggctcaggccaggcacggtggctcatgcctgtaatcccagccctttgggaggccgaggtggaaggatcatttgagtccaggaatttgagacaagcctgggaaacgaagaggattcctgagatcactgtctctataaaaaatcagatgggcgtgttggtgggtgcctgtagtcccagctacttgggaggctgaggcaggaggatcgcttgagcccaggagttggaggctgcagtgagctgtgatcacaccactgcactgcagcatgggcgacagagggagaccccgtctcaaaaaacaaaaaacaaacaaactaaaaaaacgaactttttttttttttaagaaaagggctcagagccaggcgtggtgactcgagcctataatcccagctactcgggaagctgaggcaggagagtagcttgaacctgggaggcggaggctgcagtgagccgagatcacgccactgcactccagcttgggtgacagagcaagactccgtctccaaaaactaataataataaaaaattttaaaaagagctcagggtttttttgtttgtttgctttttgttgtttcttcaaccatctccttgattgttaagtgggtggaggaagactgttgtacctcgtgctccacccaggctattggaaaataaatctggtgattttcagtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggtgagagccatggggacttgaccttgctgccttctctgtctggtgcagagaaggtggggattggggagggtggaatttgaggtctgcaggataaacgtgtgccctgggagttgactgttgattgccacctgtctcaaataaattgcagtggcgtcttgccactgcttctcctgtttaactaactagtcttagaagatgctttccactttaagacatgctttatgggatagaagacacaagtcacgatttctgcatttgaagtggcagttttcatttcttttgttgcataaacccttactgggtgccagataagatctctgtcttttgggagtgcattgtttggtggaaaagacaaagcagagtcagtgacaaggtgttgtcagtgtgatatatactgagctgggagaaatcacaaggctctcctacccacatccagaaaggggacggttagagggaaggtcaggaaggcttctggaaggtggtagttgaggggggttgtgaaggaggagtaggacttagaaagtggggcacagtcgcctgggagaggagtcagcgtttgcaaagtcatgaagctaccgggacacagctgggctactgtaagtagctgagtatgtaatagaggaggctggaaaagcaggcagagggctctgagcgaggagggttatgtgggccatgccaagactcgggagtggaaggattttaggagatttccatgagggtcattttattaattatttttttgagttggggtctgcttctgctgcccaggctggagtgcagtggagtgatcatagttcaccacagcctcaaattcctgggctctggggtagctgaggtgcctaccaccatacccgactaataattttatctagagacagtgccgctctacgttgtccaggctggtctctaactcctggcctcaagggatcctcccatcccagcctcccaaagtgctaggattacaggcctgagccaccgtgcctggcctcgtgagggacattttaaaggagcacactggaacatgtggaatgggtttagactggattattcgctttgtggcggtcttcttacatcatgccagcttcttcgtggggagaggcaggtgagtggttttgccctcagttgcttatagtctagttgaagagataaagtggacatagagaactgaaaaggaacttgctaagagggtgttttctttcattctttttgttgttgttgttttgttttgtttgtttactttttgagacagggtcttactctgtcacccaggctggagagcggtggtgcaatctcagctcactgctcaacttcacctcccaggctcaagagggtcttgtgcctcagcttcccgagtagctggacttacaggtgcacaccatcatgcctggctgatttagagggtgtttgctttctgctgggcacgtccaggcatcgtgggaagtgctgtttaaattgggccataaaagggtgggtaaggtgaggacaggggaccaagtgggtgggattcagggtggagcagagtcatgggggtcgggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggtgtgtaaaagacaggatcagaacgttagttcaggaagcttaatcttttctgcccccccatctgagatgtacaagagggttagaaagcagagttggagaagctgtttgggagggagcacttatttgtttttttgttttgttttgtttttttgagatggagtctcgctctgttacccaggctggagtgcagtggcgccatcctggctcactgcaacctccacctcccgggttcaagtgattctcctgcctcagcttcccaagtaggtaggactacaagcacctgccaccatgcctggctaatttttgtatttttagtagagacggggtttccctctgttggccaggctggtgtcgaactcctgacctcaggtgatgcacccaccgaggcctcccaaagtgctgggattacaggcgtgagccactgcgcccggcagggagggggtaaagtgagaggcataagggtcccggccaggtgttagcagggggcttcagaggtgaggagagagcagggcaggcagctgctaggcctgggggagcgggctgcggaggactgagaatctgaggtttttctcttggccgcctgggggaaatccagggggaaaaggagaatgaggaaggaagatgcgtttggcctcagacgtgttgaaggtattaagaggccaacaggaaatgaggccatgggctagagagaagagccctgattcattccccaaatgcctcccgaaattctgtgcgccgaggcttgtgtttggcacttggagtacaaagatgaattcagcagtctctttggtgtttgccttatcagctaagctgagaacaagattgattagtacacactcctcagtgttcatgcctgacctacttttccttatttagtaagttatttttaataaatgtagtaagttctggcaatctaggcacccaaaacaaaagctgggatcatgaaacaaaagtatatatctaatcttttttttttaattttaaaaaactttaaaaagttttctactttatcaggtccccttagaacatctaatcatttcatttgaacttgttttctgttcttaccctgaggtaatcattatctcctttctttcattttttttcttagttttatcttacatgtgtatttctttgtttctctgtctcttttttttttttctttgaggcagagtttcactcttattacctaggctggagtgcaatggcacgatctcggctcactgcaacctccgcctcccgggttcaagctactcccgattctcctgcctcagactctggagtagctaggattacaggcatgcgccaccatgcccggctaattttgtatttttagtagagacagagtttctccatgttagtcagactggtctcaaactcctgacctcaggtgatccacccgcctcggcctcccaaagtgctgggattacaggcgtgaggcaccacgcctggcctatttctttctttttttagagacagtgtctcgccttgtaacccaggcagctggagtgcagtggcatgatcacggatcactgccgccccaaattcctgggttcaatggatccatccccttcagcctcctgaatagctgggactacaggcacaggctaccatgcttagctaatttttaaagtttgtgcagaggcagcttcactgtgttgcccaggctggtgttgaactcctgggctcaagcaattcacccgccttggcctcccaaagtgctgggatgatagacatgagccaccatgctcggcagtgttcatctttcgtagctattgctagaccatttcctgaatgaagtgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgattttaatccttcgtgtctattgcaaatatcttctcccagcttttaacctattattcctctttctttaaggtgtcttctgttgatcagccattcttcattttaacatagcgaaatgtattttttccctagtactcagttttctgggtctggtttgaagtcttttcctgaacataacccttgcctttaaggagcgtatgcattctccagtggaggagacagataatggcactgagacgtcatgtgggcattgattgttagaagtggccacttctgcctgtggagcgggagcgaacttaggaaagatctcacagggcagagtcttgagctaggaattaagagatgagtaagtggacaagtgcgatgggcattctcagtgggggacgaagggcatgaaacatcctgacctgccctgggcgctgccaggaggtccagatggcaggagctgatggtttgaggggctcgggcagggcatcccgaggacagctttgggtgatctgtatgcaagggaatattgaagccatgggaacagatcctgaggatccgggcggaatggagagaggaggggaggaggggagagggaggccagggcctgattcccggatgcagagaatgttatcaacgcctggtgtggctctggggagcacctgggacttcccaggggcgggtgctgttggcatgctgcctgctgtgctgttggatgctgtatttcacccttaggtgttgggcaaaggctgacatgtctgcagagggcagggcgtgttgttggcaaagctagccagaggcagagcactctctcactttttgatagagacatgagttcagagaagtattgctcaactgtaggagtgtgaaagtacagtaatagatgtgagggaggccacagggcagaggtctgcaaacgatggaccctcagccaaatctggcccactgccatttttttttttttttttttttttttttttttgagatggagtctcactctgttgccaggctggagtgcaatggcacgatctcagctcactgcagcctccgcctcccaggttcaagaaattctcctgcctcagcctcctgagtagctgggattacaggcaccagccaccatgcctggctaatttttgtatttttagtagagacaaggtttcaccatgttggccaggctggtctcgaactcctgacctcaggtgatccacccccgcttggcctcccaaagtgctgggattataggcgtgagccaccacgcccagcattttttttttttttttttttttgaggcagggtctaactcctgcccaggctggagtacagtggcacagtctcggctcactgcagcctccgcctcctgggttcaagtgattctcctgccccagcctcccaagtagctgggactacaggtgcacgccactacgcctggctcatctttgtatttttttggtagatacggggtttcactgtattggccaggctggtctcaaactcctggcctcaaatgatccacccacctcggcctcccgaagtgctgggattacaggcgtgagctaccgcattcagccccactgcctgattttgttcataaagttatattggtatgcaacccctcctgtttacacattgtttatggctgttcttgtggtctagtggcagagtcactggaaagactttttctgtcctttacaggaaaagcatgctggccctagccatagggagtcgtggtagctgtggccacccagagaggacgttccagccaccattgcagtttagctggtgttgctaggtagatcatggatctaggtccagcctgcaaatattgccatcttttctgattttcaagggaagcttgaaatctagatttttttttttttttttactgtgaatattccttttttttgagacagattctcactctgtcgcccaagctggagtgcagtggcataatcttggctcactgcaacctccacgtcttaggttcaagcaattctcctgcttcagcctcccgagtaactgggactacaggcgctcgccaccacacttggctaattttttgtattttttagtagagacagggtttcactgcattagccaggatggtctcgctctcctgacctcatgatctgcctgcctcggcctcccaaagtgctgggattacaggtgtgagccactgagcccggccaaatattccaatttttaaacatcagctcagtttttaaaagccaaaccttagtaacccaagcaaaacacatctacaggccagtttgtccgtcgtcagtctgtcttggtgggaaagacaggaactctggaaacagatttgggttttctcagcccctggatatccttgggcaagctgcatgtcttctggtgactcacttttctcagttgtggtatggaaatatcccgcttccccagttgtgaggaccaacgagaattactagtcaggtggaggggcttagcacggtgcctggtgcctggtaaacctttacctggtagccattgctgttattcatttatttatttattttacacaataatttacttattgagagccttctctccccgcccttgcagtctctaggtcactttttccacttgtagattttgtgcccaagccccagaaagatggctgggggcaggggctctgcgtactattcgatgagacccataacgtggctgtaactgtctttctcatactgcaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgcttttcttgggcataaatatctgatttctggtttccattcggtctttttttttttttttttttgagacggagtcttgctctgtcgcccaggctggagtgcagtggcgcgatcttggctcactgcaaactccacttcctgggttcacgccattctcctgcctcagcctcccaagtagccgggactacaggcacccgccaccgcgcccggctaattttttgtatttttagtagagacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttgtttaaagagacagggtctcgctctgttgcccaggttggagtgtagtggcacgatcatagctcactgcaactttgaacccctaggctcaaagcagtccttctgcctcagccagtcaaagtgctgggatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacacagcggtggtggtggtttggtttatatttatgaccttttaaaagtgtttggcattttcagggaggtttgttttttgttttgttttttgaggctcatgttgcccaggctggagtgcaatggtgcagttctcggctcactgcaacctccgcctcctgggttcaggggattctcctgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaaaaagaaaaaaaaaggtcttctatcgtttctccactcaaagacagctgttaacattttattgacttctatggagtttgccctatgcttctgttttatgtaatagagacagtgctgtagtgaatagcttcacgtcaacatttttctataattttctgaagttagagtcttaattattggatcaaaggaagtgaacatttttaaacctcttgatacatatattaccaaattgtttgcttttccgttttttttaataaatagagatgggggtctctctgtgttgcccaggctggtcttgacctcctggcctcaagcgatcctcttccctccacctcccgagtagctaagattataggtgtgagccaccatgctcagccgctgattttaacttgtatgttttaaacaaaatttctagtaaagtagaacatttctttgatatgtttgtgtcaggatttgactctcccaggtctttggagaggctttctaacaaggcatcccccgtgggtggccatctgccctgtgagaaggtcatttctagttccaggtcacgcacagtgtgtcagctggtggggtgtggagtttcaggcccaggcctcctggaaagtgcccgaaagagaaacggcttagaaaataaggactttaacggtggtgtgggttgagtttggaaagtttagaccatgttagtggaatcagagctgggaagaggttctagaagttacctcctctcactggtttccagtccacacttctcagaactctcccattttgcagtcaggtgcagtggctcacatctgtaatcctagcacttgaggagaccgaggtgggcagatcacttgaggccaggagtttgagaccagccctggccaacatagcgaaaccccgtttctactaaaaatacaaaaattagccaggtgtggtgtggtgcacacctgtagttccagctactcaggaggctgaggcatgagaatcacttgagcctgggaggcagaggttgcagtaagccaagatcgcaccactgcactccagcctgtgtgatggaaggagactctgtctcaaagaaaagaactcacctattttgcaaaggagcttcatggttctcttgaagaaaaataggaatggaggccacctctgtgtcaaaaacaacatcccacatttctgtgtttcactttttttttttttttttttttgagactgagtttcactcttattgcccaggctggagtgcaatggcgcgatctcggctcactgcaacctccacctcccgggttcaagcgattctcctgcctcagcctccctagtaggtgagattacaggcatgtgccaccacgcccggcaaattttgtatttttagtagagatggggtttctccatgttggtcaggctggtctcgaactgccgacctcaggtgatccgtgcctggcttacttttttttttctttttctttttcttttctttctttctttttttttttttttttaagagatagggtcttgctatgttgcccagactggtctcaaacgcctggcctcaagtggtcctcccaccttggcctcccaaaacgttgagattacaggtgtgagtcaccacgcttggcgtgttttacatgttgacggacagcatataatcacatgtataagggtttctgcttgtaaaagtctggaaacccattctaactgccagaatcacaaaacctagagaaggggacataactgccctgtggccacccagtagcttttatcttctctcgcgacggcagaggcaggacagccagcattctggtgaggattgaaggattagttgtaagagatttcagcaggtctgcagtgatcagatgggtttctcacatattgttaagttgaaagtagccgtggctcagtatgagttgagtacctgtttaaaatctgcattcaaagccttcttcccagaggccacaactgcagtgagatccaagtgtgtggctcacccgccccggggctcacagctgggcagggtgatttccactcaaattcttgtgccagtgcagatcttgttctaaagcttttctaaatgcctggagactagaaagacttttggatacttttccctttttcttttggatgaaatttcatctccagtagaacagcagcattccatggtgcctcagccacgatcctctggagagagatttgcggcgaagacctgacgagagactgtaaaggaaaagcagggtttgtttttcctggtcaaagttgttaatactaaaaaaaaaagaagaaaaaaaaactttggccaggtgcagtggctcacgcctgtaatcccagcactttggaaggccaaggcaggtggatcacctgaggtcaggagttcgagaccagcctggccaacatggtgaagccccgtctctactaaatacaaaaaaaaaaaattagccgggcttggtggtgggtgcctgtaatcccagctacttggaaggctgaggcagaagaatcgcttgaacccaggaggcggaggttgcagtgagccgagatcacgccattgcactccagcctgggcaacaagaatgaaactctgtctcaaaaacaaaaacaaaaacaaaaaaaaccctttgatcattaaaaagttatatgactattttagaacatttgcaagtacagaaagaggtaaagaaagaatagcccaggtgcagtggctcacacctgtaatcccagcactttgggaggctgaggcgggtggatcacttgaggtcaggagtttgagaccaacctggccaatgtggcaaaaccacatctctactgaaaatacaaaaattagccaggcgtagtggtgcgtgcctgtaatcccaactacttgggaggctgcagcaggagaactgcttgaacccgggaggcggaggttgcagtgagccaaaattgcactgctgcactcctgcctggcgacagagcaagactccttctcaaaaataaaaaaaagaaaaaaaatcccataattctttgattccagtgacattttagtgttgttctttccagacttttaatttttaattaatttatttttatgagacagggtctctgtctgtcacccaggctggagtgcagtggtgcaatcatggttcactgctgcctcaacctccagggctcaagcaatcctcccacctcagcctcctgagtagctgatactacaggcacgcaccaccacaaatggctaatttttctagtttttgtaaagacaggcttttgctgtgttgcccacgctggtcttgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccccggagcagaaggctcacccctcctttggtgtttcagagcctctgggatattgggcacctgaagaactgcagccgcagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtgggtatcaaaggtggcgggcttggtgtgagtaggaacagtggctggtcatggaggggcttgtgtgccttgtcatcctctggagtctccagtaccctcctagggcctgggccatggcgcgccctccattggggaggctgcgtgccttcgtggaaagttttagctgaagtcctcgcctatatttcccaggctgttttgcagagttgtgagagttggttcatcgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcctgcccgcccgcccgagggcactccaggtctgatctttggggcgggttgtgggcttttgtcggaggaattggcagctccgtggcgggcctggcacccacagagctgccaattcctgtgttcggagttgttgcaggcctgactcacctgtgttctcatgctgtgtactcagggctgcccttgtggccgttcctccttgagactgaaagggtgggcaagtgctaggggtgaggggccaggagaggcagggaggccaagatgggttgactctctgctgtatgcctagtgctgtgtgggcaccttatacacacccgtctgtgttatcctcatgaaaaacacttaggatacatgttgataactgcattttcccaaagaaagcaagcttggcgagcttagatacttccatcaagatgatacaatagccaggcatggtggcgcgtgcctgtagtctcagctgggtgacagagggagacccctgtctctacaaaaaattaagagatcagttgagtatggtggcacatgcctgtagtcccagctgctcgggaggtggaggcaggaggatggctttagcccaggaggccatggggctgcagtgagtggtgattgcggccactgcactctagcctgggtgacagagtgagactcggactctaaataaataaataaatgaataaataaataaatgtcaccttttattaagtagtgtatgtgtgaccttgagttattcaaccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgagcatacacatcatattttatccccattttgccaatgaggaaactgagacccaggtagttacagtgacgtcctcatagtcgcgtggcttgtgataagatggggaccctggcttctggtgtggtcccagactgtactaccccagcaaggtttcagtgagaagggtaagaccaccttccctggaagggagacagatgtggagcagcacctggaaagaagcaggcctgggctctggcatcagtgtgcacacacactgcatcagctctgatttttttttttttttttttttttgtagaggtgggacctcttgtcactgaggctggagtgccttgggattatagctcactgcagcctctaactcctgggctcaagccatcctcctgcctcagcctcttgagtagctgggactattggcatgcacctccgcacctggctaacttttaaattttctgcagagatgggatctcactgtgttgcccaggctggcctcaaactcctgtgctcaaaccaccctcctgtcgcagcctccctaaacactggcattacaggtgtgagccaccacacccagtccccttgacctctttcagccttggtttcctgtccgtaagtgggagaaatgtcaccttggcagtctgtgcagcttaggagagacaagtacatttgatgttggttactaaatgttggaccctggaccggcactccaacagccggtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgagaccagcctggccaacatggtgaaaccccgactctactaaaaatacaaaaaattagctgggcgcagtggtgcatgcctgtagtcctagctactcgggaggctgaggcaggagaatcacttgaacctacgcgggaggtggaggttgcagtgagccgagatcacacgcctgggtgacaagagtgaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggtggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctaggagtttgagaccagcctgggcaacacagacatcatctctacaaaaagtaaaaaaatgagctgggtgtggtggtgaatgcctattgttccagctgctctggaggctgagttgtgaggattgcttgagaccaggagtttgaggctgctgtgagccaagatcacactgctgcactctagcctgggtgagagagtgagaccctgtaaccaaaaaaaaaaaaaaaaatcagctgtggaaaagcatcacgtgtttcccctgcgctgaggctgactctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggtaagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccgaccacagaggttgaagggttcctttggccggcaggccagcatggaggtggtgcgtcataggagttcagagggccctgtcccaccactcagtggctgtgtgccctgggcaggcaactgcgcccctctgcgtgtgtgcgtttctgctttttggtctgcgatgtgttttgatcttttttttttttttttttttttttttttgagacggagtctggctctgttgcccaggctggagtgcagtggtgcaatctcggctcactgcaacccctgcctcctgggttcaagtgattctcctgcctcagcctcccgagtagctgggattatagacatccgccaccacacctggctaatttttgtatttttagtagagacggggttttgccacgttggccaggctggtgtcgagctcctgacctcaggtgatctgcctgcctcggcctcccaaagtgctgggattacaagcatgagccaccgcacctggacctgcagtgtgttttgatcagtattattgagaatgaggcaccagtttcctctcggagccatcccttactctaatctggtggttgtcactgggggtgattttgtccccggggccatctgacaatgtttggagacactgttggttgttacagctgagtgggtgggaggtgggggtgctcctggcatctggtgggtggaggccagggatgctgctcgccatccggcagtgcactgggctggccctgcagtaaggaattattggcccacagtgtcaccagtgaggaaacttgagaaactggtttttccttttttttttcaattttaattttagttttattttaaaaagtatgggttttttttatcgtgtttgtttgtttgtttgtttgttttttgtaaagactgggtctccatcgccctgtgttgcccaggctggtcttcaactcctgagctcaagtgatcctcctgccttggcctccgaaagtgttgggattacaggcttgagccgtcatgcccagccctggaaactgtgtttccaggagtgtcgtagagtctgtgaaaactgtggctgtcagtcagctcccaagtcattgccttcacagtgtgtgaagtcaactgacaaagatagcagacaggataaataataacatggaaattgcatatcgtggcagagagcaggaagtgttaatcggggaatgaaagtggcaggtgttgtagaggtcgatttgaagttaggtgggtgtggtgtcatgtgcctgtagtcccagttatttaggaggctaaggcaggaggatcgcttgagcccaggaggtcagggtggcagtgaactatgatcacatcactgcactgcagcctgggtgacaaaggggtaccctgcctctaacaataaataaataaacaaatagcagcatgactgtgtacctactgtgttcctatttgtttattttggcggttgaaaaaagaatttgaacgttccctgtatcttggggatgctagcagactaacctttggttttcctttgaaaacaggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcaggtatcgtgggcaacggccgctcgttttgtctgccctgtgtttctgctcttagctgggaagactcaccccaattcctgcagatgcggctcctgccccctaggtggtcctgccgtggcatctcatttgcatgtggcatgtgggtgccgaggtgccgtggccgtccagagcctacctgaccccttgtacctgagtcctggcagtcaccacacgggttagaatctacagtcctttcactcacgatgattaagggcctccacatggagcagttaaaggcctgtggcctctgcttgcgggctgcatggcgagcattgtgcccgagaacactgggtcactgcctgtacactgactcccgccttgtgccaggccctaaggacccagagaccagagtatcagcccttacccctgagccctagtctagtgcaaggggctgtcagcgcggtgtgagggagggcagaatgtggagcacgtggcagtggctgcaggtggcacgggtgacctggcccccgtgatgatgcagcccagcccagagtgcctggtagagcgctcagctccttgagagagagagagaatgataccacgggcccagtgcagaccagagcgggtggcatttaaaatgaggagattggtcaggcacagaggctgacacctttaatcccagcactttgggaggccaaggcaggaagatcatttgaacccagcagtcagagaccagcctgagcaacatagcgagaccccatctccacaaaaaaaaatttttttaattagccaggcatagtggtacacacctgtaatcccagctacttgggagactgaggcaggaggattgctggagaccaggaggtcaaggcagcagtgagctgtgatcgcgccactgcgcttcagccccctaggtgacagagcgagaccctgtcttaaagctgggcccagtggctcacgcctgtagttccagcactttgggaggccgaggtgggcggatcacctgaggtcaggagttcaagaccagcctggccaacatggtgaaaccccatctctactaaaaatacaaaaattagccaggcatggtggccagcgcctgtaatcccagctacttggaaggctgaggcaaaagaatcccttgaacccaggaggtggaggttgcagtgagccaagatcgtgccactgcgttccagcctgggcaacaaagagcgaaactccatctcgggggaaaaaaataaaaaagataaaatgaggaacccccccaggatttccctggatttggccaaggtgaatgggctggccgtagccctctgactgtctgggtgacttggggcttcgtcattcattattgagaatgttgggcttggagcacattttgagaattcagagtggtagctgggacagggctttctgagagtgccctggtgcgggtggtgagggagtgggtgggcctggggccgccctggtcccagggaggaaatcatctcctttctccgcactggccctggtcggcatcctgctgcctccctgctcaccggcccacccctgcccaccgcagccacatcaagggctgaaacttcacagggtggttgagaccgccttggcagcttcttggacctctagtatttgttcagactgggtttccgaggaccctgccagcttgtgtaagacacagtgacagcgcctcccgctcattggttcgtgtcatgtgccaggccctcctgagcaggctgcttgagtgacttcactcatcccacgatgctctcaggctgagcagtgttcttcgcttacaggagagcacattcaggcccatgaggttggcgacacagccagcaagtagcggagctgggattcagcccagaccccaagagtgggctatctggggcacatggggagttattgacattcccgggaaggcagggggctcttttaatacattttaattttattttattactatttttaaagacaaggttttgctctgtcacccaggctagcgtacagtggtgcaatcatggttcactgcaggcttgaactcctgtgctcaagtgatcctcctgcctcagcctcctgagtagctgggaccacaggtatacaccaccacacccggctaatttttcagttttacgtagaggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttccggggcatcttctgccaggagttggggcacgtgcatctgagatctttctgggagttgggagtataggaaggtgtcatcggggctctctgaggacatagacataggcaagccaggctcagggagatgctcccccaacttccctccctgagtatctgggtcagcctgtttcagagaacagtgtgctctatctgctggcccaggagggttcttagaggtgctgggacttctgtcagccctgttccactcagcttcctggagcttcttaagttcttaggaattattttgaggcaaatttctagatagtgctagagctgggattctggagttaagtcatttaatgtggatttgttcctttctcctggtattgggcctcgttggtctttcctaaaccatttccgtttctcccagtatttctctggggtccccgtccctggcctgagggcccccagaagtgctgatgtgggtcctaccggtgtgggccaggcaagttacagaaaagaaggtggatgggccagtctgtcttcccttggtgctggggtgggcatgctgtggcttgccccacgttgtaagtcaggagggaaccaggccagcaggctctgttagtggaaacagcctcaaaggggcctgcctcctggggtaggtgtaggtgcatcctgattcctttggttttcttggagctgggagaggtgtaattcacctgcacgagcctatctacgcgctgaaaaacaggcttttcccctgcctgatttgtagtgaggccccctgcagttaaccctcctctgacggatgtagagccagatggggcttagtaaatacctgacctcttaacctagcaggcggcaaggttctcacagccaagtgcatgtcaacagcatcaggtgaaagttaccttggatgtgaggaggcaggcagggcaggcagggcccgtctagagccagcgccatgggctggggaagcccgagaaccgactttttactggcagccactggaaataccatgtgagcgcgtgaaattgaaaaatttcctggaactcacgtgcacagcttccacgtgccccctgggaacaggccgtgatacaagaaagcgtgtcatctggggctgagctgctgggtggcagtagatttcctggtagctgaagttgatccctttaagcaccaaaacttgtgttttaatgatgttggatggaaatctttcctaaatgtgtcatgcatgctcttgtctcccttaatggagagagtgtgacactgcttagcacttggatggcttggggtggtggttatgaccagcagtctgtcacagctcagcgaggtgaagcctgtgggcgttttgctctgtgctgaatggctcagtggccctgcaaaacggcgctcagctcttggtggctttctgttgtggtgggctgctgctgctgctgctgctgctgctgcccttgcctctaaaagaactcacttcctcttcctcctgctgccacctgtcttttggcttgtgggattggagtcatggggcccagatggagccttgctcctgacttatgataggccctcggtctcttttcttctctatttttttcttctttcttttctttttctttgttttttgttttgttttgttttaagagacagggtctcactctgtcacccaggctagagtgaagtggtgtgatcgtggctcactgcagcctcaaactcctgggctcaagggatcctcctgcctcagcctcctgagtggccaggactacaggcttgtgccattgtgcccagctaattttttaaattttttgtagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcaccactgccctggcggcctttgggaatcatcctcacaggtagaggaattgaggctcgggaaggggacttgccatgctcagcacacacggctttgagcgggagcatacgcctctagcatcgtctccagcctctgcagctcatgggactggctgccagccccaatcccagagggtgtggacttggagaggggctttggatctccttcctctccggcctcctggctttgcccctcgccctgcatagaaaactcggagtcctcatgtctcacgtttcccactctgtctgggatctcctggagatggtcacagacaggaaagccagggagggcctaataggtggaccaggagttggggagaggaggagggtgcctgaggccatgactatagggacttctcagagaaggacacttcaggaggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctccattcacagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatacaaaaattagccaggcgtggtggcgggcacctgtaatcccagctactcgggaggctgaggcaggagaattgcttgagcctgggaggcagagaggttgcagcgagccgagatcacgccactgcgctccagcctggatgacagagtgagactccgagaaaaaaaaaaaaagtggggggaagagttgaaaccagctgaggaaggggaggagcttgctccaaatgaatgaaactgagtgttcagtagagtcaggaccttgacccaggtgtccagactccctgcccttcttagcattatcagggcccccagatccactaccagccttgcctttggatcgggagtaggcaaggagagcaagaagctgctctttgcttagcacggccacagaggcaatcctgtttgagaacagtcaacaaacaaactcaaacaggccatgcacagtggctcatgcccataatcccagtgctttcagaggccaaggtgggaggatctcttgaggccaggagtttcagaccagcctggacaacatagcaagattctgtctctctctctatatatataaaattagccaggtgtggtggtgctcacttgtagtcccagctactcaggagggtgaggcaggaggatcacttgaacctgggaggtggaggctgcagtgagctatgatcgcaccattgccctccagcctgggtaacagagcaagaccccaactctgggcccagcatgcttccagtgtgtcactctaccggcatgaccctacctcttaaaaaaaagaaatatgatgacttaagaccaaatgagtggccaggtatggtgtctcatgcctgtaatcccagcactttgggaggctgaggtgggcagatcacctgaggtcaggagtttgaaatcagcctggccaacacggtgaaacccctgtctctactaaaaatacaaaaattagcagggtgtggtggctcatgcctgtaatcccagctacttgagaggctgaggcacgagaattgcttgaacccaggaggcagatgttgcagcgagccaagatcatgccactgcactccagcctgggccacagaacgagactctgtctcaaaaaatccaaagaccaaatgagtgacttgaacataatcattgtagggaacacaaccctcatattaaaaaaaaaaacaacaacaacctttattttatggtaattaagttccggaaaagttaacaaaagtagttgggtttccatatctccctcatctggcttctgacattaacagctttcataaccatggttcagttgtcagatccagaaaattaccactggttggctgggcacggtggctcactcctgcaatcccagcactttgggaggccaaggcaggcggattacgaagtcgagagatcaagaccatcctgggcaacgtagcgaaaccccgtctctactaaaaatacataaattagccgggtgtggtggcacgcacctgtagtcccagctactcaggaggctgaggcaggagaatcgcttgaacctgggaggcagaggtttcagtgagccaagatcacaccactgcactccagcctggtaatagagcgagactccgtcccctcacccccgcaaaaaaagaaaattaccactggtataatactcttaactaaaggttttttttttctttcttgatttttcaccaatttcccactactgtcctctttctgtcccaggatccaatccagggtcccactttgcttccagttcttattctccccgtcctcctctgggctggaacagtttgtcagtctttatctttcataaccttgttactttcaaagaggtgctttgttgaatgtcccttaatttgagtttgtcttgttttcccatgtttggacaaagataatgccctttgttatttcttttttgacagagtctccagcctgggctggagtacagtggtgagatcatagctcactgcagccttgaactcccaggctcaagtgatcctcctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgatcatttgctaaagtggtgtctgccaggatttttctcctctaaacaggtgctatgagaacctgctttttttttttttttttttttttttttttttttgagactgagtttctctctgttgcccaggctggagtgcagtggtgcgatctcggctcactgcaacctctgctgcccgaggttcaagtgattctcctgcctcagcctcccaagtagctgggattacaggcgcctgccaccatgcctggctaatttttgtagttttagtagagacaggattttgccatcttggccaggctcgtgttgaactcctgacctcgcgatccacccaccttggcctcccaaagtgctgagattataggcgtgagccactgcacccagccattttttttttttttttttgagatggagtcttgctctgttgtccaggctggagtgcagtggcacggtctcagcaacctccacctcctgggttcaagtgattctcctgcctcagcctactgaatagctgggactacagctgtgtgccagcatgcccagctaattttttatatttttagtagagatggggtttcaccgtgttaggatggtatcaatctcctgaccttgtgatccacctgcctcagcctcccaaagtgctgggatttcaggcgtgagccaccacgcctggcctgagagcctgcattttgatgacactagtgagtgtaaaatatctttttttttctttttattttctttattcacaacaggtatgaaatgattgttttcagagtcttttttttttttttgagacagggtctcactctgtcgcccaggctggactgcagtgatgtggtcatggctcactgcagcctcaacctcctgggttcaagccatcctcctgcttcagcctcccaagtacaggtgcgcaccaccacacttggcagacttttaaaaatttttttggagatggagtctcactatgttgcccaggctggtctcaaactcctggcctcaagtgatcctcccacctcatcctcccaaagtgctgggattactggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccagggagcgtccctgccactgtgcccatgcagatgccaaagcccagcagagtccagcaggcgctcgcaggtaggtgcctgccctcgggctgcagagcagtctgtgccctgcgggacttggtggggaggaaattgtgatgtggggccttgtcaccctctggatcctcagggagagccagaggggctccctgggggagcagtgcctctttctggtgatggtgtcaccccagagtgagcccaggtgcccctccttttgctctctgggtacgtgggcctgatgacggtgggcgctcgggtgcagaccttttcacatcctttaacatttttgcattgaattgcattatatttaaatagtcactttcctgtcctgaaatactttaaacatttccttaaaggggccctctggggaattaatagatctatttcggctgtagttactcttacatcttgaataagaggcaccttttgggtccaaccagatcttttgctgtactaaccatacatcttacatcttggaactgttttgggtttggtttggttttttgtgagacaagagtctcgctctgtcacccaggctggagtgcagtggcgctaacccagctcactgaagtcttgaactcctgggctcaagcaatcctttcaccttaaggatccttaaaaatacctactgctggcccccacacccattctgttttagcagcctggctagcagggttttcagaagctccacaggtggcaggattttttttcttttttctttttttgagatggagtctctctcgcccaggctggagtgcagtggtgggatctcggctcactgcaacctctgcctcccaggttcaagcaattctcctgcctcagcctcccgagtagctgggattacaggtgcatgccaccacgcccgggcaatttttgtatttttagtagagatggggtttcgccatgttgaccagtctggtcttgaactcctgacctcaagtgatccatccgcctcggcctcccaaagtgctgggattacaggcatgagccaccgtgcctggccattttttttttcttgttataagtgacaggatcttgctctgttccccaggctggtgtgcagtggtgtagtcatagctcactgcagcctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctgccacgcccagctgaggttattttctaacttctggaaagttcgaggtatgtaaggaggtggatggcgccatcgttgttcacagggtgatgtggcggaattcaataatgagttggtgttttaggggagttgctgtcgtagtggctgagaggggacaggcctggaggtagggcggctggtgcagagcctgacctcagacctgggggcaccagccaaggcctgaccagcttcgaggcagtggagttgagggggaggtttggcttgaaacattcagaggcatgagccgtcaggcggggggttgtgaggggggattgggggtagactgaggcctgctggagtgcagccagtgacaactgaggagcagcctggggcttggcgtgtgtgaattcatttcgtccttaaatcactgaggtggaggcttttgttcccattttcattagaggaaactgaggctcggagaatttaaaaattctctgccagcccttggcagagctgagacacagccccgggccttcttgcctatgacggttcagtgctgctgagtctagggggaggttgggagggggtgatggctgtggagtggccgttggagctgttccggggcagtgggatttggctgtgggcctcagaagagcagtcttgggtggaatggggtgcccctgacccctcgtgggagcgtgtgtgccacagagaccgtgggcgggactgaagagaaaatgaaggagcggccagagaggtgggggcaggagggagaggagctggagcggggcaggggagacagaatgagcaagacacactggccagaaagtccctgctcactgaagtcaccgtgcggcgccgtagggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctgagtgccctgggtgtggagttagcacctgcccccttcctctgctcttgaggctgaaggtcctgtccaggctgtgtcccaaattgtccatcctgttgtctgtccccgttgctctcagagcaatcctggagctaaagcaggtattttaacatccattttacttgtggggaaatagattcgggaagctggttcaggcctaaggaaataggagagcctggaggctgtgtggactcctgcctcccccaattcaaggcccagtgttggtacctactgggggagcattgtctaggggagcagggaatgagaggagcctggccagcaccccggagccagagctggagagcagtgtcctgtcaccctggtgtgcttgtgggttgaggaattataccatgcccggctgcggagatgagcgtttgcgcacagggtttttgcagggaggtttataaccaggaggtcatgctttggaaggactgagtgctggaggcactgcttccaagtgacagtgcctccaggtgacagctcccctggctgtggcatagcccagtccctctatcgggtgggggcagggactgtgaggctggagccagggtctccacccctcacctggtcacagcagcggtccatccacagctcacactgctgcctggggcagggatgggtgtcagcagcctgcccaggactgctcagctggtgagggctggcactgggctcgaacccaggctggggaggtcagagcgcacagaggagaggcttggatctcagccctggccctgggtgtcagaaggaggggtgtctgcaaattggaagtgagaatcagtgagtgggggcttcactcttcagggctctgacagcgggaatcctcccagatgggtggagaaaaaggctgtggccctccgagttattcaggtgatttgggggctgtcaggagtttggggggttgtccctagccctcctcctctccaggcttctgggttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagtacggcggggcgggaggcttggagggacaggccccgtcaggcagtgttcagggaaggcctgcccgccgaggcagtgttgccggagaaccctgggtagggagacgtgtcctggcctttggtcctcccagacgacgtgggcagcgcagaggcaccaggttctcttgaggaaaattgcacctgtccctgtcctctcccatctgtctgccacccgcgcccgcttgtccttctctccacccgacattcagttcccacaggaaccgcatttgagcccaggaacaagcttgggatgttgggggcattgagctcccgggctcaaacctctgtcctctgatgcacgctttggtgtctcctgctgagcggccactgcaactcaccctgcccacctcggctctgctgcccaggctggtggctggtctccgcttctgtccccacagccaggcacatgtgccgggttgagaagctttgttcttctagtgggggcgcagtggctggcctggccgcccttcacccctgagtcacgccatctgttcctggatggggagtggggtccaggaggactgggatctctaccaactcccccggcagccggctgtgcccagctcctgagccaggttctgcagaccctggaagccaccttaagggatggctaagaagctctgggcttcccctttctctggagaggaggtgcttttgacctaactgaccgatgacagggaggaccggggagctggcactatggaaagtggggtaggccgagggtgtggcaggaacgggttcgtccagcaggacacgctgtgtcccaggaagcgctgggtcatcagggagcacgaaggaagcagtgtcagaggagagtcccccagggcaagtgtggggttccctgcaggcatccggcagtggtgagctctggaaagagtggccggtctgtcccagcatagctgctggccacaggcccacccttgcccgagggcgccagagccacagcctggggccttgctgcagcccagccctcacagtatggggatgctgcagtgtgggagcaggcccaggggccacgttcctgcccgcctaccccagcgctgtcgctgaaggccctggcacccagatcagccaggaggggcatggagcacacacagcgcccagtggaggctggaggcctagtaactccaagccaggagggcccagggcctcctggggaagctgagcccttggagccagccccacccaggagaccccgtgccccgggcggcttcctggagtggcgtcctccgccctctgctctcctgaagtcacgggtcctgccccggtgcccacctgcacactgagggcacgggcttgtctgttgctcctatagaaacctgtgggctctggggccagggctaccatgagccaggctgccccaccctctgattcctggcctgggtagtccccagggagacctgtgcgtccccgtggccattgatggtgtcacatccttggcctgagcagggtttgttggcgtcacatgccgaaggagtcttctaatgtctctccctctctgcgtgtctgctctcacgcccgtgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggtagttcttgttcccaaaagctctctggcctttgctaagcctccttccggcctcgctgcctccgactcttctgcacagaccctcttccttctctctgctccctgactcctgggggaaggggctcagtggcccttctccctgcccccgctcggcagcagaggcggcccctggaagctgactttccaccgcagccccagagttcagctcctctcctccagtcacagctggcatgagggggcttgttcttgaggactttgtgatttttgtaagcagcaagttgtgggtgagaggcggcgcccggctcaggatgcggggacaaccgtcccttccgccagggccagcacgtgtctcgggaaaggcccccagacagcggcccaggtctgctgcccaggtctgctgccctgacccccagccctgtgtggccgccacgtgggctgcttgagaggggtccctcggtgacccctgccctgctcgttgcatggccacagaagaaggggctttaggaccacagcaggtccagggagttacagcaagacctgctcggagcagcctgtgatggtcaagttctgaacctttcccaagcgggtgctggccctgcttccacccctgggctgtggaagtgtggactgtggccagtccagatgctcttgagtgggcgtggtggcgggcagggagggtggccgtggccctgctggccctcagtgtctgtgtcatctcagcaggtcctctcggagcctccgcttagcagaggggcttggcgaggtctaggaaatactcgaagcgcctggcatgcggcaagggtggcttccgatcgtgtccgacctccagcccacaggcgaggaggtgggctcagggaggggtgggcctcgagctcctgcccccagcccagggctctgcacgccctgcccttcccctgccctgggggaggagccagactcgttggcagcccggctggcaaccttctgtggcactcgggtttacctgggaaggacacgctcttggtgggtcgcctggctggccccttctgagacacgtggctaatggaaagctcccttctgttctgaaaagctgcaagggctggggtgggtgggcgggggtgggatgctgtgcccggcctcaccagggctgggcagaggcgaggcccaggctcacccggagatggctctggagttggcaggcttttccaaaggaaaaggcccccctcagcctgagtagggcattccagccacacggagggtgaccctgagctgggggccatcgttctggtctggcgttctcgccaccgtgacaggatttgggttcgggcagtctgtatgggtgtgtggaggtgtgggggtgtgtgaggtgtgtggaggtgggtgtgtggggtgtgtagaggtgagggtgtgtggggtgtgtggaggtgagggtgtgtggggtgtgtggaggtgtggggtgtatggaggtgtggagtgtgtgtggaggtgtgtggaggtgtggggtgtatggaggtgggtgtgtggggtgtatggaggtgtgaggtgtgtggaggggtgaggtgtgtagggtgtgtagaagtgtgtggggtgtgaggtggggtgtgaggtgtgtggaggtgggtgtgtggagctgtgtgtggtgtgtggaggtgtgaggtgtgtggaggtgtggggtgtgtggagctgtgtggggtgtatggaggtgtagggtgtgaggaggtgtggaggtgtgtggtgtgtggaggtgtggggtgtgtggaggtgtggggtgtgtggagctgtgtggggtgtatggaggtgtaggctgtgaggaggtgtggggtgtgtgaaggtgtggggtgtgtggaggtgtggggtgtgtggaggtgtgggatgtgtggggtgtgtggaggtgggtgtgtggggtgtggagatgtgtgaggtgtggaggtgtgtggtgtgtggaggtgtggagtgtggggtctgtgaaggtgtgaggggtgtgtggaggtgtgggagttgtgtggcgatgtgtgtggggtgtgtgtgtggaggttggtgtgtggaggtgtgtggtatgtggaggtggggatgtggggtgtgtagaggtgagggtgtgtggggtgtgtggaggtgcgtggggtgtgtggggggtgtggaggtatgcggtgtgtggaggtgggtggtggtgtgtggggtgtctggaggtgtgtggggtgtgtggtgtgtggaggtgtggggtgtgtgtggtgtgtgtggacgtgtggtgtgtgtgtggagatgtgtggtgtgtggaggtgtggggtgtgtacaggtgtggggtatgtggagatggggtgtgcaggtgtgtggaagtgtgcaggtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtggggtatgtggagatggtgtgtggaagtgtgtggtgtgtgcaggtgtgggggtgtggaggtgtggggtgtgtggaggtgtggagtgtggggtgtgtggagttgtgaggtgtgggtggagttggtgtgtggtgtgggatgtgtggaggtgggtgtgtggaggtgtgtgggatgtggaggtgtggggtgtttggaggtgtgtgggatgaggtgtggggtgtgtggaggtgtgggatatgcggggatgtgtgggaggtgtgggtggagttggctgtgcgtgggggggtgtgggtgtggattggggtgtgtggtgtgtgtataggtgtggtgtctttaggtgcggggggtgtggattggggtgtggtgtgtgtaggtgtgtctgtaggtgggggtgtgggtgttggtgtgtgtgtggaggtgtggggtatgtgggggtgtgtggaggtgggggtgtgggtgttgtgtggggtgtgtgtggggtgtgtggaggtgtggggtatgcggggatgtgtggaggtgtggggttgtgggtggagttgggtgtgtgggtgtggaatggagtgtgtggtgtgtgtataggtgtggtgtctttaggtgtggggggtgtggattggggtgtggtgtgtgtgtaggtgtgtctgtaggtgggggtgtgggtgttggtgtgtgtgtggaggtgggtatgtgggggtgtgtggaggtgagggtgtgggtgttgtgtggggtgtgtgtggggtgtgtggaggtgggtatgggggtgtgtggaggtgtgggggtgtgggtggagttgtgtggggtgtgtggaggtgtggggtatgtgggggtgtaggtggagttgggtgtgtgtgggggggtgtgggtgtggattggggtgtgtggtgtgtgtgtaggtgtggtgtctaggtgtgggggctgtgggtgtggattggggtgtgtgtgtgtaggtgtgtctgtaggtgtggggggtgtgggtggaggtgtggggtgtgtggatgggggttggggggtgtggtcttgccagcagtttccctccaggtcacagcagccatgccatcacagcaattccagcttggttacatattcgtctttcccgtttgagatcagggaaccgaggctcagaggtggcatgattcgttcacagcaagagaactagaattaaacaaactgtgccgactccagcctccgccccaccacgccacctccctgccaaactgtcccctccctggccctttttggtgtaaagggagttcagcaggtgcagctgtgcgccctcaggcttagaggcttagaattctctgcagcacctaaaggccgtgagcttggattcaaaccagagccccttctggtcctggagtctgggacgaccgcagccccaccatgaccttggggtggagcccctgtcaggagcgcctccacgggtggcactgggctccccgtccctctttcacccccgcacgggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaacaactccacatggaaaggacatccgccccatcttgcttgaagggtgcttcccaggtgcctctgggtgccagggccttgctccagcccctttggtttcatctcccagcctcccgagacccacatcgttatgatctgagctttgcacttaaggagctgtggtcctgagcaaagcccctcctctcccggccctggcctctccatagcctgatggccatcctgggagcaggaattccagagacaagggatgggccagcctgccccactctccaccttgcggatgctggtgtagaagtgaggtggcctcgtccaggtggctgtcctgtcccccggctattgggagagctggtcaaggttcttataatttttttattcttaaagacgggtgcacactgtcacccaggctcagtgcagtggcgtgatcacagctcactgcagccctgtcctcctgacctcctgtaatgaacaggaccaatcagactcctattgcgcttccatagaacctgaacctctgctgagccacgttttgggggctgcagcaccactttcccctgattttagctgggagcccgggagatactgttgggggagggggtgggcgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcgtcctcatgtgtcccaccccttccacaagcccttgccacattcccgcctgcccagcgctcagctctgtctcggccctggtgtccatctggtgtgactgggccgtttcaccccaggctcctcctctccaagctgccgtctgcacagccagcacgcagcttggatcatgggagcactccctgcctggaacccccagcaggacccccaactcacacacaaccccaagcccctgagtgtggcagccagacccccgagggcgcgcctctccctgatcctgtctcatctcctgctcccagcccaccccctgccagctttagtgcccatgcgctggctcctcgttcagaacgtcctcctccctcttccgggtgcccactctgtgcttgtccatctggcaattcctgtctcccttgtaagaccccactccgagggcctcccccaggatcctgccctgtccgtccttcccatttggtggcttctgctgtcatgtcgggcctgtgctgctggtaagcccttcaagggcacaggtcccggtgactcacctgtgtctccagcctgtggaatggactttttttttttttttctgagacggagtctcgctctgtcgcccaggctggagtgcagtggcataatctcagctctgcaacctctgccccctgagttcaagtgattctcttgcctcagcctcccgagtagctgggattataggcgcctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctcttttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaactgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcaccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatggcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattcccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctttccatggcccgtgtcaatgccggtatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgtattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcacctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctgtacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccttgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcaagcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttggtgctcaggggcaccaccaggagaggcctccggctgaggtcagcttcccagagaggaaggtaagggactgtccctagctcaggactggcacccaccctgcagagagccacgccttcctcaggagggctctgctggacagagacctgatcaagggcgtctcccactccttcaggatggagacaaaagcccaactggtggccgagagtggtggcttatgcctggaatcccagcacactgggaggccaaagcaggaggatcacttgaggccaggagtttgagacgggcctgggcaacatagcaagaccctcgtctctattaaaaatataagaaatatgccagacgcggtggctcatgcctgtaatcccagcactttagaatgctgaagcaggtggatcgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtctcaaaaaaataaaagaaattgaatacattgatattttgccaggaccctgccttctacaggcatctagtctaatgggactggcagtaaccaaggcagatgagctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaagaagcagtgaagccgagccaggaaataccaagatggcgagccagtgtgcttgtagagattgtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcgagtgatgcgagggggacctgaactgtggcctctgtcatgggaacccagaggaggtcgatggcgtttgtggttgatgtgggaaggagagagagagagaagaaccagaaacgtctgcttgctggaggaagcggcatgtccgctcctccactccttttcttttccccttaggagcggtttatggttccttttgttttattcttttatttgtacactggcattggagtttgtttttttggcttttttttttttttttgagaaaaagtctcactctgtcacccaggctggagtgcagtggctcgaccttaacttactgcaacctccacctcctgggttcaaagggttctcttgcctcagcctcccaagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatctgagaagccagaggaagggttttgggtgatgctcccaggatggtgggctccgatgggatctttggagggggtgtgtctaggtcggctggtgtcaggagggtcttttgtgtgccaggcagagaactgtcccaaggagctgagagtagaggggccaggagcttcagggctgcagccagactgtggcccagggctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttcttgatttttatttttatttatttattaatttattttgagacagagtcttgctctgtgggccaggctggaatgcagtggcctgatcttggctcgctgcaacctctgcctcctgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctttttttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacacccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttctttttttttttttttttttttttgagacagcgtctcactctctcacccagaatggaatgcagtggcgctatcttggctcaaagcaacctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtccttccctggtctctggctctctgagtccctccttttttgttttgttttgttttgacacagaatcttggtttgtcacccaggctggagtgtagtggtgcaatctcagctcactgccacatccatctcctggattccatttattcttctgcctcagcctctcaggtagctgggattacaggtgcctgccataatgcccagctcaattttgtacttttagtagagacagggtttcaccatgttggccaggctggtctcaaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccagtctcaagtgattctcctgtctcagcctcctgagtagctgggattacaggtgtgcaccactaccacttgactactttttatacttttagtagagatggggtttcaccatattggccaggctggccttgaactcctgacctcaggtgattcgcccgcctcggcctcccaaagtgctggggttacaggcgtgagccaccgcacccggcccccttccttcgtcttagtcaaccctatcccacctcttcttccaccagtcccctcacctgatggtcccaacacttcatcatccaccacctcctggagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaatttttttttgataaaaaataaaagagttacatgacattcagagaccatccaaaaaacctgtgggttcccggctgggctcagtggctcatgcctgtaatcccagcactttgggaggccacagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctggtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttggtgacctggggctgggtgggcctctgagagcctttatagctgattgccttttgggagagggcaggtgggagccccaccctgtctcatgagtcaccccaaaggtgcatgggcaggcaggtgctggggaatcggctactccccagagcttggcgtggccatccctctggcccctctgggagtctggagcccattccctcacactggtactcactgcagctggggacatctgcactaggaagacaggacacggcatggaagctggcctctgcccagaagccatgacattctggtcaccagcctgatgttataaaacgagtgtcatggccgggcatggtggctcacacctgtaatcccagcactttaggaggccaaggcgggtggatcatgaggtctggagttcgagaccagccgggccaacatagtgaaatcccgtctctactaaaaataagaacattagccaggtgtggtggcacatacctgtagtcccagctcctctggaggctgaggcaggagaatcacttaaacccaggaggcagagattgcagtgagccgagacgacggcattggactccaggctgggcaacagagcatgactccgtctcaaaaacaaacaaacaaaaaaaacgagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagatcagcctgggcaacatagcgagcaccccatctccagaaaaaatttaaaaattggctgggcgcagtggctcatgcctgtgatcccagcactttgggaggccgagggggatggatcatttgaggtcaggagtttgagaccagcctggccaacatggtgaaaccccgtctctactaaaaatacaaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaacctcccccaaccaccctcagctcaagcaattctcatgcctcaaccctcagcctcatgagtaactgggactacaggcgtgcaccaccatgcccagctaatttttgtatttttagtagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctggatagccccctacccacatgcctcagcattgggaggtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtcgactaatgacccttgtccctcccctcagctgcctctcttttttctttttttttgcttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcgaactcccgacctcaggtgatccgcccgcctcagcctcccaaagtgctgggattacaggcatgagtcagcgcacgcagcccatcttaagctttttttttttttttttttttgacgaggtctctctctgtcattcaggctggagtacagtggtgccatctcagctcactgcaacctccacctcccaggttcaagcgattctccccgcctcagcctcctgaatagctaggactacaggcgtgcaccaccacgcccagctaatttttatatttttagtagagacagagttttaccacgttggccaggctggtctcaaactcctgacctcaggcgatccatgcacctcggcctcccaaagtgctgggattccaggcttgagccaccgcccctggcccatcttcactatttttaagtggacagcacagtagtattaactatatgcacatcgttgtgcaatagatctctggaactttttcaccttgcaatactgaaaccctacactcaacaaacaactcgctttccctgccccgctccagcccctgaaaacttctactctcctttctgcttctgtgaattgtactattccagatacctcccataggttgaagcaaccactatttgtctttctttgtaactggctcatttcacttagcattatgtcttcaggtttcatccatcttttagcatgtgtaagaatttccttccttgctttgtttgtttgtttgtttgtttgttgagactgagtttcactcttgtcacccaggcttagagtgcaatggtgcgaacttggctcactgcaacctctgcctcccgggttctcttgcctcagcctccagagtagctgggattacaggcgcctgccaccatgcccggctaatttttgtatttttagtagatatggggtttcaccatgttggccaggctggtctcgaactcctgaccgcaggtgatccacccacctcggcctcccaaagtgctgggattacaggtgtgagccaccacgcctggccttgtttttgtttttgtttttggagacagagttttgctctgtcgcccacgctggagtgcagtggtccgatcatacctcactgcagcctcccctcctaggctcaagcaatcttcctgcctcggctttctgagtagctcaaactacagacacacactggtcatgaaatccttgcctaagccaatgtctagaagggtttttctaatgttatcttctagaatttgtacagtttcaggtcttagatttaagtctttaatccatcttgagttgatttttgtataaggtgagagatgaggatccagtttcattctcttacatgtggctagccagttatcccagcactatttgttgaaaagggtgtcctttccccactttatgtttttgtttgctttctcgaagatcagttggctgtgtttgggtttatttctgggttctctattctgttccattggtctatgcgcctattattataccagtaccatgctgttttggtgatgatggccttaaagtatagtttgaagtcaggtaatatgatgcctccacatttgttctttttgcttagtcttgctttggctatgggactcttttttggttccatatgaattttagaattgttttctctaactctgtgaagaatgatggtggttttttgatggggattgtgttgaatttgtagattgcttttggcagtatggtcattttcacaatattgattctacccatccatgagcatgggatgtgtttccatttgtttgtgtcatctatgatttgtttcagcagtgttttgtagttttcctcatagaggtctttcacctccttggctaggtatattcctaagtacttcatttttttttgcagctattgtaaaaggggttgagttcttgatttgattctctgcttggttgctgttggtgtttagaagagctactgatttgtgtacattaattttgtatctggaaactttgctaatccttttatcagttctaggagctttctataggagtctttagggtttttgaggtaaacaatcacatcatcagcaaacagtgacagtatgacttcctctttaccaatttggataccctttatttccttctcttgtctgactgctctggctaggactttcagtactgtgttgaagaggagtggtgagagagggcatccttgtcttgtttcatttctcagagggaatgctttcaacttttccccattcagtattatgttagctgtgggtttgtcatagatggcttttattacattgaggtatgtcccttgtatgccgattttgctgagagttttaaccataaagagatgctggattttgtctaatgctttttctgcatctattgagatgatcatgtgatttttgtttttaattctgtttatgtggtgtatcacatttattgacttgcatatgttaaaccatccctccatccctggtatgaaacccacttgatcatggtggattgtctttttgatatgttgttggattcggttagctagtattttgttaagaattttagcatctgtgttcatcagggatatcagcctgtagttttcttttttagttgtatcctttcctggttttggtattagggtgatgctggcttcatagaatgaattagggagggttccttctttctctgtcttgtggaatagtgtcaataggattggtaccaattcttctttgaatgtctggtagaattctgctatgaatcagtctggtcctggacttttttggttggtaatttttaattaccacttcaatctcctgcttgttattgatctgttcagggtatctaattcttcctgatttaagctaggaagtttgtatctttccaggaatttatccatctcttctaggttttctagtttatatgcgtaaaggtgttcatagtagccttgaatgatcttttgtatttctgcccccattttgtttcttattgaggttatttgaattttctctctttttttcttggttaatcttactaatggtctatcaattttatttatcttttcaaggaaccagcgttttgtttttatcttctgaatttttttgtttgtttcaatttcatttagttcttctctgatcttggttatttcctttcttctactgggtttgggtttggtttgttcttgtttctctagttccttgacgtgtgaccttagaatgtcagtttgtgctctttcagtctttttgatgtatgcatttagggctgtgaactttcctcttaggaggaaaggtggcctttgctgtatcccagaagttttgataggctgtgtcactattgtccttcagttcaaagaattttcaaatttccatctggattttgtttttgacccagtgatcattcaggtgcacattatttaatttccatgtatttgcatggttttgaaggttccttttggagttgatttccagttttattccactgtggtctgagagagtgcttgatataatttcaactttcttaaatttattgaggctcattttgtggcctatcgtatggtctatcttggagaaagttccatgtgctgttgaatagaatgtatcctgcagttgttggatggaatgttctgtatatatctgttaagtccatttgttccaagatatagtttaaatccattttttcttcattgactttcagtcttgatgacctgtccagtgctgtcagtggagtaatgaagtccttcactattattgtgttgctgtctgtctcatttcttaggtctattagtaactgttttataaatttgggagctccagtggtaggtgcataaatgtttgggattgtgatattttcctgttggacaaggtcttttagcattatataatgtccttctttgtctttttcttcttcttcttttttttttttttttttgagacgtagtctccctctgtggcccaggctggagtgcagtggcgtgatctcagctcactgcaacctctgcttcccgggttcaagcaattctgcctcagcctcccgagtagctgggattacaggtgcccaccaccacgcctggctaatttttatatttttagtagagacagggtttcaccatattggccagggtggtcttgaactcttgacctcaggcaatctacccgcatcggcctcccaaagtgctgggattacaggcatgagccactgcacctggcccttctagtcttttttaactgctgttgctttcaagttagtttttctgatataatagctactcctgctcgcctttggtgtccacttgcatgaaatgcctttttacacccctttaccttaagtttatgtgagtccttatgtgttaggtgagtctcttcaagcagcagatagttggttggtgaattcttatccattctgcagttcttatcttttaagtggagcatttaggccatttacattcgatgttagtattgagatatgaggtagcattccatttgtcattttatttgttgcctgtgtactttggttttttgtttttgttttttaaattgtatttttgttttataggtcctgtgagatttatgtcttaaagaggttctgttttgatgtgtttccaggatttaagatttagagctccttttagcagttcttgtagtggtggcttggtagtggtgaattctctcagcaattttttgtctgaaaaagactgtatctttcatacacaatgcctagtttcgctggatacaaaattctcggctgataattgttttgtttgagaaggctgaagatgggccccaatcccttctagcttctagggtttctgctgaaaatctgctgttaatctgataggttttcctttatcagttacctggtgcttttgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgatttattcctatggttgttctggagctaaaatgcatgacacgagcctctacacgctgctctgtccgtccgagtcagagccgcaatctagtcttttaaagggctctctccacctttaaaaacccttacctataagccatctgagagttcaagtgttaagtataatctgcctgattctccttgcttggtccctacaaacaaaggctttcccttctcttgctacaagccttggtttagatatggtatagatacatagtcttattacgctgggcgagtggacctccgtttggttcaataacaaaatctgaactgaggagagttgtgattacactattgcatttcatcataaatattttccttgttgaatccaagcacacaaagtacagaatgatcctcttcctcagtacagtttttccctctgttatactagtaccatgatatcctcagctgaagaaaaggtgctagatgctctgtaccatctgatctttttgtcaggtgcttttctgatgcaaattattctctgaattcttatctctccctttcactctgagccataatcttgtctatgtcctggagctcattgcgtttttcccagaacacagttgagtattcaaggacctcccgtaagctttttccctcttcttctcttgctatattttcaatatcacaaccccattttaattagctttgataagctggttaaaatctctgagttcaattggtaaatccctgtgttaactctatctcttcatcaataaggggttcagcttatttaaactgttctttttctgtgcctatgctgcatttggtaggtcgtgattttgaggtaccttgtacccagttgcttttctgtaatacagagtttctttttctagtaattaaaataaatgttgggccagatgcggtggctcacgtctgtaatcccagcactttgggaggtcagggtgggcagatcacctgatgtcaggagtttgagaccagcctggccaacatggtgaaaccccatctctgccaaaaatacaaaaattagctgggcgtggtggcaggtgcctgtaatcccagctacttgggaggctgaggcaggagaattgcttgaacctgggaggcagaggttgcagtgagccgagattgtgccattgcactccagcctgggcaacaatagtgaaactctgtctcaaaataaaataaataaataaaatttaaaaataaaataaaataaatgtggaggaaagaactggaaatcctgaaatttttgttttttcaactttttcttcttttttaatacaatttagcaccaataataaagcatcaataatagtaaggcttttctacatatctgagatctcttccttaatatattatttatcacctccccaataatatatttgttacttatggagtgaaaagccttcaacctatttccttttgcagcaatagaggccaagcacagtgttactgctctcaagaaaaagaacacacaagcaatttcagcttagaaacaatacttaaaagggaggacagtttataaaattccatctaggttgcttgaaaatagctttctctatcttgccaataagtaatttactgaaacttctttgtactttgacctgaatctgtggagactctattctattaataatttgtaaagtttataaattccttcctacaaaagtttttcaacatatattggaatctggggtttcaaaagccttcctccttatttacttctctttgccaattaaaatcacacactgtttctttgaccaagaaatgggaaaatgactactctatccctatacactgtggcttccactaagtgggaggaaaggcttcctaggacatgtgtttaactctgtaatttgctctcgaaactgctgccccaatgtacccaaatatatgaatctctatgttctttttatttaacccaaaatatacctgatctattctgcactaaatatcaacaacaaagacagggctccaggaagtaacttgcagaattgtcttgtttaaaaataggattaacaagcttcttggtaaggtgagctttttcctgcctccctccccactcccacttctaaccctgtaacattctttgtttatgtacatttggttcagagggatacttctgctgctgccttattattaataatagcagattaaacttcagtgcctcagggttggaggattctcttttatactacaaacactttgggccgcccactataggaagtgccatgctaagtatattagggaggttcaaaagatgtgaaaagacacaccagtgctctcacaaagcttaccaactcactaggaaaataaatcatacactatgaaacaacatgaaagtaattactctgaaattttattatttttaacacatacatttcacaaacaatacctttaacaccacatacaattccataacaaaatattttaattttgtcaacgttcttttttgtttgttttttgagatggagtctcgctgtgtcactcaggctggagtgcagtggtgcgatctcggcttactgcaacctccgcctcccaagttcaaatgattctcctccctcagcctcctgcctcagcctcccgagtagctgggactacagccgcgtgccaccacacccagctaatttttttgtatttttagtagaaatggggtttcaccatgttagccagtatggtctctatctcctgacctcatgatctgcccgcctcagcctcccaaagtgctgggattacaggcgtgagccaccgtgcccagcctcaacgttctttaactttttacaatcttctctcaacaaaagtgtaacccaagataccttgacaagaaatcttccagataaatatttttgagctagtttcaatgatgcctatccactaaattttctctcaaatacttgcaataataataaagtcaacagtactctaggcaagagtatactgaggaagtacacaattaatcagttcttcccaaaaaataatcgtaatagtttcttcctcaaatcttttcttctgcaatgtctaatctcatccattgtatttttcatctcagacactgtagttttcatttatagaaattcaattttggtcttctttttatatcttccatgtcttaagtgtttgaacaagtgcaatacagttataataacttttattttccttctctgctaattcggtcatctatatcagttttgggttagtttcaattattctcttcattataactcatgggtttttttgccctttgcatgtctgataatctttgattcaatgctagacagtgaaaccacctctgcaaaaatcataactgagaaaattattacagtgaaagagatctgacataaccagctccatcttgcttctaatcaccaagctgtccttgttcatttctaggtacaggctgaactaacttttgggaggaatttagtttatagtttagctttgaaaccaagacaataacagccatttcccaaacaaactccattcctgcctggggactagactcccttttcaggacaacaaattagccaaaagattagaaattgtggtttaggagtcatgtagctggaagctgcccaaattgctaaacctccccaaattgctcctgcggataacatcactattgtaaaacctaagatcagtgcttgaaatattttgcagaccctaaactcagtcgatcggctggcataacccagattgataagctggctcatctggtcttgtggcccccagtcaggaactgactcaacacaaaaggacagctctgactccctatgatttcatctcagactgactaatcaaaactcctaactcactggccccctatcaaattatccttaaaaactcagatcgtcagattctcagggagactgatttaagtaataataaaactggtctcctgcatagccagctctgcgtgaatttctctttctctactgcaattcccgtcttgataagttggctctttctaggcagtgggcaaggtgaacctgttggatgggttacaacattgtgaattttactttgttgggtgctggatatttttgtattcctgtaaatcttgagctttgctcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactccatcttgatctccctaactcagggagtgttctagactccagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttcttttcaccctcttttttaacttattttgaaataatttcatactgacaagttacaaaaacagtagagagaggttctgtatacccatcactcagttcccctaatggtgacagcttctataagtatactgcactatcaaaaccaggaaattagctggcaaattaactggactatagaccttactcagatttcaccagtttttacatgcattcatttttcgggtatgtctttgtatatactcatgacattttatctatcacatatatagcttcatatataaccatcattttaatcaagatatggaactgttctgtcactacaaaggaagtcccttgtcatgtccctttaaagtcatactctccttctccttccctaacctatggcaaccacttgtctattctctacatctttaattttgtcgtttcaacaatgttatataaatggaatcatagagtatggaccattttgagattggcttttttcactcagaataatgcccttaaattcccttcaagttgtttacatcaacagattgttccctttgtcggtgaattaccttatgtggacataccatgagtcatatgaacattcagtaatggaaggatatttaagtcatttccagttttttggctattacaaataaagctgtgaacatttgtgtacaggtttttgtgtgaacataagttacatttccccaggataaatgcccaggaatataaatgctaggtgattaatggtagtttctttttttttctatttttttaagaaactgccagactgagttatagagtagctgtatcattttacattcccaccagtaatgtagaagagatccagtttctctgcacacttgccagcatttgaataatcagtatttttaatttttgccattctagtaagtatgtagtattttattctggttttaatgtgcatttccctaatggctagtgatgttaatatctttttgtgtatttatttgccatcatatatcttctatggttgcactgtttcttaaaagttacaagattaaacttctgtgtgcacgaatcatgttttcttcactactggggatagttcacttaggataaggatttggctatggtttaatatttcttgaatgaccaaaataaatacaaagacaataataaaacaaaaccccacaggcatcacaaacagaactcataatgctctgagattggggcctgcactttgaactctagtctagggatcagcaaactatagctcacgggccaaatctggccaggggcctgtttttgtatgccctgaaagctaagaagggcttttactttttttttttttgagacggagtctctgtcacccaggctggagtccagtggcatgatctcggctcactgcaatctctgcctcctgggttcaagcaattctccctgccttagcctcccgagtagctgggatttcaggcacccgccaccacacccagctaatttttgtatgtttagtagagacagggtttcgccatgttggccaggctggtctctaactcctgaccttaggtgatccatgcacctcggcctcccaaagtgctgggattacaggcgtgagcgaccgtgcccggccgggcttttacatttttaaagggttatttaaaaacaaaaaaatatatgcaacagagtccatatgtaatctgctaagtctaacatatttactatatggtgtttacagataaagtttgcagatgaatggaaagaaaacctgatcttcttttttggggcaaacattaacaacattgacatctgattacccatgatactctcaagatcttattctttaacaaaaaggtggggaaataaaaacaccataaaagcggccgggtgcagtggctcacgcctgtaatcccagcactttgggaggccgaggtgggcggatcatgaggtcaggaggtgagaccagcctggccaatatggtgaaaccctgtctctactaaaaatacaaaaattagccgggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatagaaataatgactgaagttgtgagaatagttttaaaacaatctaaattttagaaaggcatatgattccatgaataaatgaataaaaatatgacaaaatagctttagcttataattcaaacatgcttacatatgccaataattttggttatgctatgattcagagcacagttaaacaaacttgtattattgttttagattattgggaccaaaaataggtaactctcttggctccttatcaaattcaagcattagatcacaagttgattctcactatatttgatacccagtcacacactgcataattatgtttcagtcaacgatgaactacagaaatgatggttgtcccataagattataatagaggtaaaaaactcctatcacctagtgacttcgtagccatcctaatggttgtttaaatgcaatgcactacctgcatttgtggtgatgctggtgtaaacaaacccactccactgtcataaaaaagtatagcacatatgttatgtgtagttcataatacttgataatgagaataaatgaccgtgttactgatttatgtatttactatactttttatcgttagagtgtatatcttctgcttattaaaaaaaaaaaaaaaagttacgatacaacagcctcaggcaagtccttcaggaagtattccagaagaaggcattatcatcacaggagatgacagctccacgtgtgttattgcccctgaaggcctttcagtgggacaagatgtggaggtgaaagtgatactgacattctttacccagtaaaagcctagactaatgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaagttttttattttattttatttttttctgagagggagtctcgctcttgctcagactggagggcagtggcgcgatattggctcattgcaccctctgcctcctggtttcaagggattctttttcctcagcctcctgagtagctgagattacaggcgcccgccaccacgcccggctaatttttgtattttagtagaaatgggggtttcaccatgttggtcacgctggtctggaactcctgacctcaaacgatctgcccacctcggcctcccaaagtgctgggattacaggcgtaagccaccgtgcccagcctcaaaaaattttttaaaatgtaagtttataaagtaaaaatgttctttgggaagttgaggtgggaggatcacttaaggccaggagctgaagacaagcctgggaaacatagcaaggccttgtctctgctaaaaactttttaaaaattagctgggcatggtagtgcacacctgcaacctagctactagggaggctgaggcagaaggatcacttgagcccagagtttgagtttatagtgagctataattgcactccagtctatgcaacagagaaagcagctatctctagaataaataaagtaaaaaagttacagtaaactaaggctaatttattattgaagaaacttaaaaataaatttagtgtagcctaactgtacagtgtttataaagtctatagtagtaatgtcctaggccttcacatgcactcaccactcatcatactgactcactcagagcaacttccagtcctacaagctccacttatggtaagtgccctatacaggcgtaccatgttttatcttttataccagatttttactgtaccttttctatatatagatatacaaataccattgtgttacaattccctacagttttcagtacagtagcctgctgtacagggtgtagcctaggaataataggctactacacagcctcagtgtatagtaggctgtaccatctaggtttgtataagttcactctataatgttcacatgacaacaaaattgcctaataacacatttctcagaatgtatctctgtcattaagtgatgcatgactgtacttagattttcatcaaatttttgccacttaactatgggtttgcccattaagtggcatgcagttatatctgggagtgtataggtattatttttattcctgttatgttttttgttaatattctatgaattttaacagacaactttcttaattttcacgacatataaaatgaatacctaaaactgaaatttgatcttatgaagaccaccctcccctactccccaattcttcctttttctagttggcatctcatggatttagcttgtagcattcatccctatacacggtctaattgcaatgtcctccttgatgccattctggtaaaatttaaaggaaaacttcaccagcattaatttttttattcattaaaacaacaaaccttggccaggtgcagtggctcatgcctataatcccagcactttgggaggctgaggtgggctgatcacctgaggtcaggaatttgagagtagcctggccaacatggtaaaaccctgtctctattaaaaatacaaaaaaaattagccaggcatggtggtgcatgcctgtagtcccagctactcaggagggtgaggcaacagaatcgtttgaacccgggaggcggaggttgcagtgagccaaggtcacgccactgcactccagtatgggcaatagagtaagactctgtctcaaacaacaaaaaaaccaaccaatgacaaaccttaaaaaaatagtatcagccaccactgtagccagatataatgaaaaatgtacaaaaacgattcacatttgtgctactgagaatttgttgttctgaaagagcaagtttaaaatgtacataccaaacaaaattccgatttactccagtcacacgaagttagttttaaattttgcactataatatatgtattcagtttaagttcgagaattagaaaacagctcttctagaaaatttaaaaatcaattttacccaatgacaggactaatgagtcttcctaaatgatttaatgaggtctttttaaacaaaatgtctgcatcatattaatgataagcaactagaagaaaaaaagatgtcaaacatgaggacataataatggaaaaatataaaaaagctaaaatttccgttaagtgtaccacatttctacttatgtatggagaatggctattcatctgacagagcaaaatgcagcctccttaccagtcactgttacaacatcatctttacgagcttcagccatttcctgaacatggacttctgagttcacatcaacctctttccctgataactgtaaatgagcttgaagtgaagatgggaccttgacaataatagaacctgtaataaatataatggagagcttagtaatataaagaaatcaaaagtaccagagtctattataaatttgactgacagggtagcattgctcctgagacactgtttttactcctcagcatacagtatttatttaaaccttttccttattcccaggtgcccaaagtttccttactctcggcattcacagtaacttctgtcaagaatatgggttattagcacattattaactactagatctgcttttgccaatagtcctacacagctcatccaacaccagaaagtgagtaatttactacacatgtagcttatagataggatttgccattgagcatttaatatgagccagacccctaattacattatgttttaatccccatattaactttatgaggtattattatcgccccgattttatagataagaacttgctcaagttcccactagtgctcgtgctggaacctagactcagctcaataattacaaagcccatgcttttttttttattattatactttaagttttagggtacatgtgcacaacgtgcaggttagttacatatgtatacatgtgccatgttggtgtgctgcacccattaacttgtcatttaacattaggtatatctcctaatgctatcactccccactgccctgaccccacaacaggccccggtgtgtgatgttccccttcctgtgtccatgtgttctcattgttcaattcccacctatgagtgagaacatgcggtgtttggttttttgtccttgcagtagtttgctgagaatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgccacgataaacatacgtgtgcatgtctttatagcagcatgatttataatcctttgggtatatacccagtaatgggatggctgggtcaaatggtatttctagttcaagatccctgaggaatcgctacactgacttccacaatgtttgaattagcttacagtccacccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatatcctttgtccactttttgatggggctgtttgtttttttcttgtaaatttgtttgagttcattgtagattctggatatgagccctttgtcagatgagtagattgcaaaaaatttctcccattcagtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggtcttcttctagggattttatggttttaggtctaacatttaagtctttaatccatcttgaattaatttttgtataaggtgtaaggaagggatccagtttcaggtttctacatatggctagccagttttcccagcaccatttattaaatagggaatcctttccccattgcttgtttttgtcaggtttgtcaaagatcagatggttgtagatatgcggcgttatttctgagggctctgttctgttccattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaaaaggtccttcacgtcccttgtaagttgaattcctaggtattttattctctttgaagcaattgtaaatgggagttcactcatgatttagctctctgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctctattcctaattgaataccctttatttccttctgctgcctgattgccctggccagaactttcaatactatgttgaagaggtgtggtgagagagggcatccctgtcttgtgccagttttcaaggggaatgcttccagtttttgcctgttcagtatgatattggctgtgggtttgtcgtagatagctcttattattttgagatacgtcccatcaatacctaatttattgagagtttttagcatgaagcgttgttgaattttgtcaaggccttttctgcatctattgagataatcatatggtttttgtcgttggttctgtttatatgctggattatgtttattgatttgcatatgttgaaccagccttgcatcccagggatgaagcccacttgatcatggtggataagcttcttgatgtgctgctggatttggtttgccagtattttattgaggatttttgcatcgatgttcatcaggaatattggtctaaaattctctttttttgtgtgtctctgccaggctttggtatcaggatgatgctggcctcataaaatgagttaggaaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtccagaaatttatccatttcttctagattttcgagtttatttccgtagaggtgtttatagtattctctgatggtagtttgtatttctgtgggatcggtgatgatatcccctttgtcattttttattgcgtctatttgattcttctctcttttcttcttaattaatcttgctagtggtctatcaattttgttgatcttttcaaaaaaccagctcctgcattcattgattttttgaaggtttttttgtgtctctatttccttcagttctgctctgatcttagttatttcttgccttctgctagcttttgaatgtgtttgctcttgcttctctagttcttttaattgtgatgttagggtgtcaattttagatctttcctgcttcctcttgtgggcatttagtgctataaatttccctctacacactgctttgacataccagagcataccagagattctggtatctttgacataccagagattctggtatattgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttcctgaggagtgctttacttccaactaagtggtcaattttggaataagtgcggtgtggtgctgagaagaatgtatattctgttgatttggggtggagagttctgtagatgtctcttaggtctgcttggtgcagagctgagttcaattcctggatatccttgttaactttctgtctcgttgatctgtctaatgctgacagtagggtgttaaagtctcccattattattgtgtgggagtctaagtctctttgtaggtctctaaggacttgctttatgaatctgggtgctcctgtattgggtgcatatatatttacgatagttatctcttcttgttgaattgatccctttaccatattatgtaatggccttctttgtctcttttgatctttgctggtttaaagtctgttttatcagagactaggattgcaacccctgcctttttttgttttctatttgcttggtagatcttcctccatcctttattttgagcctatgtgtgtctctgcacatgagatgggtttcctgaatacagcacactgatgggtcttgagtctttatccaatttgccagtctgtctcttttaattggagcatttagcccatttacatttaaggttaatattgttatgtgtgaatttgatcctgtcattatgatgttagctggttattttgctcattagttgatgcagtttcttcctagcctcgatggtcttcacaatttggcatgtttttgcagtggctggtaccggttgttcctttccatgtttagtgcttccttcaggagctgttttaggggcggcctgttggtgacaaaatctctcagcatttgcttgtctgtaaagtattttatttctccttctcttatgaagcttagtttggctggatatgaaattctgggttgaaaattcttttctttaagaatgttgaatattggcccccactcacttctggcttgtagagtttctgccaatagatcagctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagactggggaagttctcctggataatatcctgcagagtgttttccaacttggttccattctccccatcactttcgggtacaccaatcagatgtagatttggtcttttcacatagtcccatatttcttagaggttttgttcatttctttttattcttttttctctaaacttcttgcttcatttcattcatttcatcttccatcactgataccctttcttccagttgatcgaatcagctactgaggcttgtgcattcgtcacatagttctcatgccttggttttcagctccatcaggtcctttaaggacttctctgcattgattattctagttagccattcatctaattttttttcaaggtttttaacttctttgccatgggttcaaacttcctcctttagctcagagtagtttgattgtctgaagccttcttctctcaactcgtcaaagtcattctccatccagctttgttccgttactggtgaggagccgcgttcctctagaggaggagaggcgctctgattttgagagtttccagtttttctgctctgtttttttccccatctttgtggttttatctacctttggtctttgatgatggtgacgtacagatggggtttttgtgtggatgtcctttctgtttgttagtcttccttctaacagtcaggaccctcagctgcaggtctgttggagtttgctggaggtctactccagaccgtttgcctgggtatcagcagcggaggctgcagaacagcggatattggtgaacagcagatgttgctgcctgatcattagtctggaagttttgtctcagaggagtacctggctgtgtgaggtgtccatctgcctgtactgggggatacctcccagttaggctactcgggggtcagggacccacttgaggcagtctgtccattctcagatgtccagctgtgtgctgggagaaccattactctcttcaagcctgtcagacagggacatttaagtttgcagagctttctgctgccttttgtttggctgtgccctgcccccagatgtggagtctacagaggcaagcaggcctccttgagctgcggtgggctccacccagttcgagcttcatggccactttgtttacctactcaagcctcggcaatggttggcgcccctcccctagcctcgctgctgccttgcagtttgatctcagactgctgtgctagcaatgagcgaggctccgtgggcataggaccctcagagccaggcgtgggatataatctcctggtgtgccgtttgctaagaccattggaaatgagcagtattagggtgggagtgacccgattttccaagtgctgtctgtcaccccctttctttgactaggaaagggtactccctgaccccttgcgcttcccgggtgaggcgatgcctcgcccttcttcggctcacgctcggtgtgctgcgcccactgtcctgcacccactttctgacactccccagtgagatgaacccggtacctcagtgggaaatgcagaaatcacccgtcttctgcgtcgctcacactggcagctgtagactggagctgttcgtattcggccatcttggctccaccccaaagcccatgcttttaaccaccatggtatttcacacactcctacctcatcgtagtacaggacttgtgacctcattattataacacaactagaacactgagctcttgtgctttcagatgtgccttgtgtgtaacaaaaaataacaatagaaaaggattatttgaattccaactcactaatgtttcttttgagtagattacaggcttttggatacctaaggtaagacactcaacctgtatttccatacaacctggctgtaattcaagcttctaaaggagtaaatcaggaaaagtactctgttaggtatggaatcatttttcgaattatgtgggttgcagcgtaaattcaccaacacactcctatttcagaagtttttcttcctgtttttcattaaataaagtaggtaaaaggcccctgccataaagcattaaccccacctctgtggacaaagatagttaggatggggtttagaatgcatttacttatgggtcgtggttttccttccaatctggctaacatcagcttaagcttccttaagtaatttcttggtcttcctaactggagctagaagtttgagataaacatgatgaactgttctattctaaaaaaaattagggaacaatgcatattactagaactagtttattttattaagaaataaattgcagccaggcacagtggcttgtggctgtaatcccagcactttgggaggccaaggtaggtggattgcttgagctcaagggttcgagaccagcctggacaacatggtgaaaccctgtttctacctcccccagctcaaaaaaaaaaaaaaaaaaaaaaagctgggtgtggtggtgcacaactgtagtctcatctacctggaaggctgacctcccaagcttaggcgatcctgatgaggctgcactgagccatgaccttgctgctgcactccagcctgggtgacagagtgataccctgtctcaaaaacaaaaacaaaaaaccaaatttctttccagggttcaaatgtaaactacagacaggagattcccataacaacatatgagggctttaggaaaaaacaaaacaaaaacaaccctggaagatttcaggataaatagaggacacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctggaacgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagttttacagttttctgtttgttttattttgcctactgtgcaaaacattaaattatttgtatgtaacagctgcttattcaaaactttgttcttactctgttactagttatattaacaatatatccttcttctctttggatctttgtgataatggagtacagttatatgacttacatgccatttataattttccctgaagcgtattacctgaagctcttagatttagtgaggacataagtttatcctattttaaagggagaaaatatgatattgagaagtcacaccggtgcatcagcaataactgaggtttcagacctctgtgttttgcagttttgacactgacaaattctagagatggattaaaaaaaactattacatcaatatggtaaagcaactactaatagcaggaacaatcagtctctgtgaggaaatattttccttgttaaacatctggccaacatgcaagagctgctagactatttaaaaaatttttttatacagagctacagttcttaactttctgcagccaagccacttcagcccctatggccaacctacttcacccaagccacttgtcaacacatatgtgtacatccatgtgtgcagaagaacagacaaattcatatttatctttcagatgaaaagtataccattttaaatgaaagagttggactcagaataagttgtgtcagaagttaaatgatagagacatatcataagtcttgatacttcaagagactaagtaatcactttagaggacctttctgtgtgatacctttatttaaggatcacactttgaaaactgttactctacactgattgcctgagaagttccttttacaggctggcagagaagcttccaaaagagtgtatggcagtgtttttccttcaaagattattctatttcagaatagaataaactgaaaaatccacagagtaacatttaaaaattccataataacagtcaaaatattacatttttgtttgtactacaaagggaaagatagtctgcatggccatctatcccaaaagttgtaaagatcactggtctagaaagctagcagaccagtgcctttaaattaggttctatcagaagatattttcttgaaatcactatgtcagtatagataatttgaccatctgtttcctgagtgttacataaaccttccttacatcatatgtcaaaataaaacattccagttcactaacctttatgggatttcaattccactttccccagttggctgacataaacatctatggcaccctgattagttgaggcttttagacatccagaagacgaatctaggaagaagaaaaaaccataagtaaaataactcttacttgataaatggaattacaaacttgaaataaaaggctctgctttagcattaggataaggggctaagaatcttgcaaggtttagtattttcctcataacaatgccattgtttgcacttaaacgtaaacagttatcagaaacctagaaatctattaaacaactaatttaaaaatctttatctatattaacctgaataacttatctctaaacatttactctaaaactttatgagtaggaaggagagtctgcaagtaatggttcctttgaccactaagcatcattgatatatttagttttttatcatgttgatacatttagtaaactttcaataattaccaaagaattctacctcatgtatagtcacatacaagcagtagcaaggctgacaaaaatcaaaacctctcataatttctccttgtagcaaatttgctgatactaagaagtgctcctaatagtaaaagattactctacataaagttgtcgcatttctttttttttttttttttttttttttagagacagggtcttgctatgttgtccaggctggtctctgactcctgggatcaagcgatactcctgggattacaggcacaaacccactgttcctggcttgctgcatttctttaaggggcagaagggcagggtggaataatttgaagaatagcttgtttatatctaatagttcttttcaagtttctggaattgaacaggtatctttaagtgaggataagaaaataataattaagataaccctgatttgtcattcaaatttccctatgtggtcgatgaccccacttttgaatcaaccagtatctcaagttcaagggaaaacagtcaaaataaggaagtaaggaaatgaacttgaagagttagtgctaagtggtttttccttcttctctttctcccatggcaattgaatctttaatttaatattctatctgactgcctggagaaagccaaagcatattctttttagagaggcctcttaaaaagcatattttatcaggaggttttattacttcaaagtggaaacaaagtagggagtgtggtgaaaactatgccaaaaattatactgtttacaaaacagagagagaaaacatttgtgtgtgtgtgtgtgtgtgtgtgtgtgtgtgtgtgtgtgtgtatataggagccaacatttttcttttaaaaaaatgttaactgacttcaaacaaagacagtaaatttggaataaactttaaaatctggctccaagatcatttataataatttatttccaatctatactggaaaatgccctttatcagactcaatttatttagttttcaagtgtcaaaagttaacactgacattgggaaatgaaaacactagagataaatgacacagaataactggacaaaatgaacatttcactgcttacgtaccaacagaaactcctttttaaacctcttaccgcatcctaaaagaagccaagtaaaaattacattatgctaaaaaaaagaaaagcgtaatacacaaggtgtgtattattccagtttgaacaaagtaaaatagctgaaacattagtgtgatttctcgctttctcaaggagggaaaaaaaacacagaatttttatgtggctcataaataatactttcatttatttttccctccaaatgagaaataaatgacagctaaataattatatcctaggccacaaagtaattatatcctcgtgttatctgtattgatctctaatgatggctcatcccttggaggctgttaaaaaataaaaaaatgaaaacgcaagatgttttcaagaaagaaggcaaaggtgatattttaaaactatgcagcaaaacaagccctcctattttttttgtttaacacaaattatcagaactaaaattaattatcaagagtaaaattaaggcttcatccacagaatttcattcttttggagtttacataatggagaaattctatggatctgggagaaagtcctgtagatctaatatatagcacagtgactgtaattaacaatactgtattgtaaacttgatatttgctaagagagtaaatcttaaacattttcatcatacacataaaatggtaatgaggtgaagtgacagatatgttaactaaacggactgtggaaatcattccacagtatatatgtatatcaaatcattatattgcatgtatgccttaaatatatacggttttgtcaattatgtctcaataaagtcagcaaaagccaaaaaaaaaaccacaccacaaaagaaaccaaaataaatctacattgtaacgtgattagctcagtgcttggcacatgggcactgagtaaatgatagatattttaaagaaagggccaggtgtggtggcttatgcctgtaattccagcactttaggaggctgaggtaggagaactgcttgaagccaggcatttgagaccagtatgggtaacaaagtgagaccttgtctctattttttaaaataataaacaagtaaataatgttaaaagaaaaatcagtcagtatagttggtcatattaataaaagaaaaatgatcatttcaataaattcaggaaatgtgtttgacaaaattcaacactcattcacgatcaaagaaagtaaaaaaggagaaacttttaagcaaacaaggaataaaagattactctcccaatctgataaaaggcatctgttaaaaatctatagctaacatcacacttaatgcattccccctaatattggggacaaggatagggatcaagtgcaaggaatcacactctcatcactacattcaacattatactgaagttcatagctagtctgataaggcaagaaaaagaaaagtaataaagataggagggaaagaggtaaaactctatttgcagttgaaaatgtctgctcagctagaaaaggattctagatttgagaaaaccgctattagaataaatttagcaaggtcacaagatacaaggtccatttataaaaatcatttgtatttacatatatcagcagtagacaattagaagcaaagtcttaaaaactgtctcatttataacagtgttaaaaacacaaatgaatttaacaaaaaaatgtgccagacctctacattgaaacttacaaagcaatgctgagaaaaattaaagaagacctaaataaatggagagagctacctaccatgttcattaattggaagatacaatgtgattcagtgcaatcccaaacataatcaaaactgtattttttggtagaaactgactggaaaatcaaaggacctattatatccaaagtaatccttaaaaggaacaaatttggaagacttcaactacctgatttacagacttaccaaagttacagtaatcatgatattgtggcactggcataaggctcaccaaataaatcaatgaattaggaacaagagatcagacattgagccacacttatatagtcatttgattttagacaaggatgctaaagtaatccatcagagaaaggaagttttttcaacaaatgatgatataaaaaaattttaaaactgacaataataaatgttgatgaggatgtggagcaactgaaattctcatacattgttgatgagagtataaagtggaactctgggaaaaggtctggtagtttatcataaagttaaacatagaacctacctagtcaactcagcaatgccatacctaagtatttacccaagaggaaaaatatatatacatccataaaatgacttacattaatatattcatagcagctttatttacagttgccaaaaaattagaaatagcccaggtgtccatcaacagtagaatgaacaaattaagccttctaatagcctgctttcacttctgaacccttctggtacattatgaaataacagctagattgttcttttaaaatataaattatatatcacttccctaacatcctgttgtagttggaataaagtctgaactcttaccctgtctacaaggtcctaagatctagccttacttacctcatatcctaccactttcctcataagccagccttctttcccttgaaaatagtaaacttccattttcaaggcctgcacttgctgttcctctatctagggagcctgtatccagaattttatataactctttctcatttttctggctttggtttaaatgtaccctctccagaccacccccaattgcctaactgaagtagctttctttttccccaatctctattcagttaccctttcttatttcttcattgtacttaccacaaactaaaattaccttttgttatttatatgcttgttgtctttcttcccagggctcagagaaggtgaagtctctgagcacagaaactatgtcctgttgaccaatatgttccctagtacctaaaagaattcttaatacatggcaggtactcaataaatacatgttgactaactagttattggtattcacaaggttgtcttcaaatgttaacacatttggagcccaataaacagtgacattatttatatctttctttcaaggacttaatttagatatttgaagaattcaagaaatttgtaagatctttttttctttcttttttttttcttcagagaagtttagcaagaaatataagacatttcttaataccagctcaggcaattttcttcgagtggacataattagtacattggttctgcctatatttgacttgtgatcctgtcaagttcatcagttaaactgtagaattcatttattctaataaagtcatcacaaatatacccatttttaaaagtggacaaaatacacgaactagtagcttagtacgtacctactgtgatgttacccatctcgctttgtaatgttatattacctgccaaaaagaaaaagatacttttatgtactagagacaatctagaaaggaactgtgatacatagcaatgctaaaacatggatgaatatctacaatgttatttttgttggcaatttttcccaatatcacaagtccagtcaaagattgagctgtagttctgaaataactggcttaggtatctctgcaaaccttctttctctactaccaaaccttaagcttttatagcataactacaaatcaccataactgctggcacagaggaaaaacaatacttctaaaacctgtaagtgaaaaaaattactgaaatgtagtcactgtacattttcaacctaaatatcaatgtatttatcagaccacacaaagcgaagttttcaaccaagtaacactaaaatatggtatggaaaaaaagaattacttttatttttcaggccacttgccatgtctattaaattaaaagtagtttctgggccaagaattaaagtggtttgagataggaataatgaatacatggaggtatgactagcaaaacagaacaaagaagcttcaaagatttccgtcttagtgaaaatatgttttccatgataagtatggaatattgcaaccattcttcccagcccctttcccctaataccaaaagtagtaggattattcttcatatgtgtgtttgtacgtgtaagtattcctagaatcaggaactcatatttattctactgaaaatataagcaataatgttatctcttctaaaataattccaaaactacactaaaaagtaaaggaataactttggcctcagaattaatcttcagtaaactcattttatctcatttcatataccttatgaatactgacttgtatcagtatctgggaaaaaccaaaaaaaggcactggattcatttactcaatagccagatgcgcctaattgcaaaaatccatctgaaggtctaatataccatcatatttcctgtgagtatatgaacaaggagtatatttgtgtatgaataaaaacttggtttgtgtactgaagcttataagattactaattttttttttcatattttagattcaggggatacatgtgcaggtttgttacctgggtatattgtgtgatgttgaagtctggggtacaaatgatcccatcacccaggtactaagcatagtacccaatagtttttcaacccttgccccgtccctccatcccccatctagtagactccagtttctattgttgccatctttatgtccataattatccaatgtttaccccccacttataggtaagaacatgtggtatttgattttctattcctgtgttaattcgcttaggataatggcttccaaccgcatccatgctgctgcaaaggatataatttcattcttctttatggccgcatagtattccatggtgtatatgtaccacattctctttatccagtccaccactgatgggcacataggttgattccatgtctttgctattgtgaatagagcttcagtgaatatgttgagtgcatgtgtctttttggaagaatgatttattttcttttgtgtatatatccagtaatggaattgctgggttgaatggtggttctgttttaagttctttgagaaatcttcaaactgctttccacagtggctgaactaatttacattcccaccaacagtgtatgagtgttcccctttctccacagcctcgccagcgtctgctgtttttttacttatttttaataatagccattctgactggtgtgagatgatatctcattgtggttttgatttgcatttctctgatgactagtgatttggagcagtttttcatgtttgttggtttcttgtacgtcttctcttgagaaatgagcaaaatgtcctgtcttttgctcatttttaatagggttattagttttttgcttattgatttgtttaacttccttgaagattcaaaggaacaaaggatattaaacctttgtcagatacagagtttgcaaatattttctcccattctgtaggttgtctatttactctgttcataatttcttttgcagtgcagaagctctttcatttaattagatcccaatgaggcaagtctaggaggacaggaatcacatctttcttatttagcttcatacctgggaactttgcacagtgcatagtacatagtaaacacaattattttgtgaacaaataaaaagtttggaaaagtaggtaaagagcaacctgtggtagaaccacagagtgctaagtctactgactatcctacaccaaaaaagttagtgaagaatttcaagatggataaaaatacaagaaaaccatgctttaaggagattcacctagtgtgagacagtgggtgtttccattctcagcattctctttactgcttgttgtggtttgaacgttcccacaaaagttcatgtgttggaaacttagtccccagtgcagcaatactgtgaggtgggacctttgggaggtaattgggtcatgagggctctaccctcatgaatggattaacccattcatgaatcaatggattaatgggtcatagagggagtgggttagctattacaagagtgagtctgttataagagccagtgtgggtgtctctcatgcagcctctctccatgtgaggcctgtgccacttcatgactctgcagagcccctatccgcaagaaggctctcaccagatgcggctcctagacctcagacttctcagcctccagaactgtaatatataagctttataaatcactcaatctcaggtattctgttgtagcaacagaaaacagactaagacactgctctacctcctgaacaataaaagatagacaggtccctgatattcgtaactttattaataaagaactatgataaagttttacagtcatttagctagtgaatccagtcacccactcatcaaggcaatggagctttatagttttacactagtctttaataatgcagtaaaaatttacaatttttttaaaataaaaatatggtctttctcaaaaagccaatcattagtgcttgtcatgaaagtgaggaggtcttgagaaaacaatgattctttgaaccagaaaaatagaagttttagatctatacaaaatgaggattagttaattatagtgggacctatagagtctcagataacattcttcttgaatgtttgagttctactgtatactaaaagcataatggagcaacaacaacaaaaacccatggaattaaggaatcgtttcaaatactgtctagttgtaagtaacacttcaaaatatttttgtcaactctaaataaaacagtaaacaaaaacttattttcaactcatatcaaaatatttagaaaatctctaccttaaacagaaatattctaaagtcattagaaaacacaaaatggatttcttgcttcaaatgcatactggaataaagtagtatatttaaaagtataccaagcaacaaaatgggcattattagcaaaattttctatattttgatttcacctacttgatctccaatcactgaaaataataaattaattatttgagaggagtaaatcttagtaaaagcttctttccaataaagcagacaccagatggtctgtaataactatgtgtgcttaccctactctcaagttatataagttttccacaaatcccagtatttgagaaaatagtttttcttagcttataacctttcattctagcatggtcagaggaaaaaaaaatgtaatcaatttaaagataaacattggtttatttttcttcaccaaaagaaatgtgattatggttcaagcacatagaactcttaaaatccaaacagagtaatcaagtatccttaaagattaagtcattttgtggtttttggtgggtaggggtggggaggtggaaagggagacacttgtatttgcaagccacagtgctaaatgctaagaatatagagatgaataaaacataatctttgttcttgaggagtttataattaggcaaggatttatagaaaaccagagatgaggcaagatgctttagctgagtactgaaagattaaaaaagtcaccaagatttttaaaaagctaggaaaagcatttcaggcagaatataaacagtatgatcagtatgatcaaaggctctgatcaagaactcagaggtataaaacaggtaaaaatgtatataggaaaaaagactaattctggaagacaaagcatacagtcagaagagggaagagggaagttgggcacgtcactaaggcagtagaaaacggtccgaataagagaatgacatgttcaatgtgcattactaataaactgctttagctgcagtgaggagaaatggatctgaagaaggcaaggctggaggcaaagttattgctagtatcaaggcaagaggtcaagagggtctaaaacagaggtgtagaaattagcaggaaaaaggtgagatagattgaaaaaatatttaggagataaaacctgcctaaacttggtagttgattagatgcaggagatgagagagaaacaggaagttaagaccactgccagatttatagcatgggaattgggaacatggcaatatcagaaacagcaaataaaaacaaggaaagaggacacattacagatgacgttcagggactggggaagaagggaaaaaagcaagaaatgttgagttcaagatgtctgtgaagatccaaatggctatgtctacctgccagatgggatgtataaattagtcagggctagagacatagatttgaataatcagatttgaaacacccttgtaagggtagttcagactcaaaagtatataagatgccctaggaaaatatgtagagaaagaacaataggacaaggatgaaatcctggagaataccaattatcacagaggtggaaagagaaggaatatagagacatttgtgaaagagcaattataaatatatgatagagactgccagtgtccattaatattggtgtgcctctcttcttccataaaagtactgctaaactacatatctcagcctttgcagttaggtaaagccatttgaaaatattttgtccaaagatctatgggcagaagtaatatatgcacttctaggcctggtttctgaaacttcttccatgatcctctgtgctgtctcatttttcatggaagacttggaagccacaaactgaggaagccaagtctctgaatgtctctaaggagctgcacttaggacagacactgtagtaaatatcaatattttgtgtcagaggtctaaaccctgaaaaacctacatggtttgcaccacaaaaaaaaaaaaagctgtaattcctttctagtatttcatataaaaaagttgtggccaggtgcggtggcttatgcctgtaattccagcactttgggaggctgagccgtgcggatcacctgaggtcaggagtttgagaccaacctggccaacatggtgaaaccctgtctgtactaaaaaatataaaaattagccgggcgtggtagcaggcgccttaatcccagctacttgggaggcagaggcaggagaattgtttgaacctgggtggtggaggttgtagtgagccgagatcaagccatcgcactcaagcctgggggacaagagtgagacttctctcaaaaacaaaacaaaacaaaacaaacaaaacaaagttatatgtgtccagattcgaaattaagcatcaaaatgataatcaaattaaaacttcataatgacctaggctaggaataaatactagaatttcaataaaacattttcatgaatgtcatgaaaag

SEQ ID NO: 1227 - DNA, 587126 bp, Homo sapiens
ctgacaccattctcaaagttctaattcttcctcctcttggaaggaggatcagatatccccagtcaagatcttgctgcttgtccgggaggagtagtttgggcctgggaccagagggggacggtagggccacctcattcatggctgtggaaagcagaggcactttggccttggtgagcccctttctctgttaaacctattttacaacatgttggtataaagatgaatatattaatgtatactagaggattttctctcacctaaaggttcatttttttcccttctgattttaaaagaaattaaaaatgtatgtcagctcttatagtgtgggcccagggcactgtgcctaatggtaagttggtccagggtaaaaagggtagtgaggtctctctagaagaccccagtgttggccgggtacagtggctcaggcctgtcatcccagcactttgggaggctgaggcgggaggatcacaaggtcaggagttcgagaccagcctggccaacgtggtgaaaccccctctactaaaaatacaaaaattagctgggcatggtggtgtgcacctacaattccagctaacttgggaggctgaggcaggagaattgcttgaacccggaaggcagaggttgcagtgagccgagatcacgccactgtactccagcctggcgacagagcaagactccgtctcaaaaaatatatataaaaacaaaaccatgagatgccacactacacccattacgatggctatactaaaacaaaaagcagtgttggagaggatgtcgagaaatgggaccctcatccactgctactgggaatgtaaaatgcagccactttggcaaacagaacctcagaaagcagcattagcatatgaccacagttccactcctaggtacattctcaagagaattgaaaatgtgcccacagaagcctgcgcacggatgctcatggcagcattatttacagtagccccacagtggaaaaaaacaaattctgcatccactgatgaatgaaagtgtgatacgttcacaggatggaatattactcaactgtgaaaaggaatgaagcaatcacagtcgaggaggaaccttgaaaaagtaacaaaagccagacacaaaaggtcacatgttgtgtgactgcatcctatgaaatgtccattacgggcaaaaccatggaaacaagaagtagcttagtcgtcactggggacgggagaatggagagttaccgtttaatgggtgtagtgtttcgttttggggaagtaagaaggttctggaattggtgatggttgcacaaccttgttgatatactaaaagctgttgggcgctgtggctcatgcctgtaatctgggcactttgggaggctgaggcaggaggatcccttgagccaggagttcaagaccaggctgggcaacacagtgagaccctgtctctacaagaaatatatttttattatattttttttgagacagagtctcactctgtcatccacgctgtagtgcggtggtgcgatctcagctcactgcaacctccgcctcccgggttcaagtcattctcctgcctcagcctcccgagtacttgggattacaagcacgttccaccacacccggctaatttttgtaattttagtcgagacagggtttcaccatgttcgccaggctggtctcgaactcatgacctcaagtgacctgcccacctcggcctcccaaagtgctgggattaccgccgtaagtcactacacccagcctcaaaaactatatttttaaaaattagcagctgggcgcagtggctcatgcctgtaatcccagcactttgggaggccaaggcaggtagatcgcgaggtcaggcgttcgagaccagcctggccaagttggtgaaacctcatctctactaaaaatacaaaaattagctgggcatggtggtaggtgcctgtagtcccagctactagggaggctgaggcagaagaattgcttgaacccaggaggtggaggttgcagtgagcagagatcacgccattgcactccagcctgggcgacagggtgagactccatgtctcaaaaaaaaaaaaaaatagccaggcacggtggctcacgcctgtaatcccaatactttaggaggccaaggcaggagatttgcttgatcctcccaggagttagagatcagcctgggcaacatagcaagatcctgtttctataaaaaatacatttttaaaaattggccagccgggcgcagtggctcacacctgcaatcccagcgctttgggaggctgaggtgggtggatcacctgaggtcaggagttcgagaccagcctcaccaacgtggagaaaccctatctctactaaaaatacaaaattagacaggtgtggtggcacatgcctgtaatcccagctactcaggaggctgaggcaggagaatcacttgaacccaggaggtggaggttgcggtgagccaagatcgagccattgtactccagcctgggcaacaagagtgaaaactccgtttcaaaaaaaacaaaaaaaaaattggcgggggtgccaggcacggtggcacatgcctgtaatcccagcactttgggaggccaaggcgggtggatcacttgagatcaggaatttgagaccagccaagccaacatggtgaaaccccgtccctactaaaaatacaaaaattagctggccgtggggcacatgcctgtaatcccagctacttgggaggctgaggcaggagaatcgcttgaacccaggaggcggaggttgcagtgagcccagatcacgccactgcactccagcctggacaacaaaggagactccatcttaaaaaaaaattaattaaataaattttaaaaattagccggagcatggtgttgtgtgcctgtggttccagctactgggaaggctgaggtgggaggattaactgaacctgggagtttgaggctccagttagctgtgaactgacctccctgggtgacatatatatatttaagccactgagctgtgaaggttgtgaaggtatgtgagttatgtcttgaaaaatacacacatagtgagcgccaaatcccgggagtagtgtttaagtggcgggcttgtcagctgtcaagggctctgcagccctttctctgaatccaagttcttcttcctgtggacagggaacccaggctgcgaactgggaggatgtggcctcgtggggggcagggccagcgtgctgtgatggggatggggctgggcaggttggggctgcctgctactccccactcctgactctgggtggggacagaaggcagagggaggctcctggcacctggggcacaggaatctcaggcatgtggtcctgagcctgtttccaaaagccagaccctcctccccagggcggagagactgggaggggccccaatccaggctccgggatggcctggctggcatctggggttccagtggcccctctcccttggccctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtacggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcccgggagtagtgctagtggtgggtttgtcagctgtcaagggctctgcaaccctttctctgaatccaagtagttcttcctttggacagggaaccgaggctgcgacctgggaggatgtggcctcctgtggggcagggccggtgcactgcaatggggctggggctggggctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaacccccactcataaggacaaagctgctttctcccctcccacctccatctgttctctcctcctgcagcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtccccggccccggtcctcccctttgcaagcccgggctccttccactgtagagtcagcaacagtgctcacccccgctggggccgggcaaggcccaggaggagcaggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtccggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgaggccctctgcggggctcctggtgccctgggtcctcaggctgctggtgattgagccccctgcccccggctactgctgcccctctgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctcaggggattctcagagcagggccaggccatgggctgctgctcttgacgggcacccccactccacatccatgggagggccccagaggagctgcctggggcttggccctgcccagggtggtcccagcctctgaagctctcccctcctcccccaccacctcccatccccagggtgaagttcctcctgatggacaccaggggctcacccagggctgagaccaagtggtcagaccccatcactctccaccaaggtagcgctgggcaggaggggcgctgcccccagtggactcacgatctctctgggccgcctctgctgagctggccacacccctgctcccacagggctgggggcctggaggccatgtccaagtcgggcccagcccccaacagaacctcatgctgggggagtggggcacccagccagccccctcggcaggggcaccatctcggcccatccgcaagcgtttgccacattgtgggcacagacagcctcccccctcctgtagggagtcagcctgtgtcagcccctgctgggagggaggaagagggtgtggaggaggtcagggtcagggtcggggctggctggggaggcagccagcttgagttctgagcagaccccaaggggcaagcgtgaatgtaccaagcccagaagtttcgagtgccacggcccaggtgtcgggggtgggggtctcctgggagacggcttcagaggtcagggggtgtggggtggaagtcttgtcatctgaaggccttgactgctgggctccagggagcagggcagtggatgagcacgtgggtgggagcagcctagaaggtaggagcagggcggaggctgtggtccaggctggcagagaacagatgctgtgccgtcccgaggaagagggacggggggtgggatcaggggggcgcctggggatatgagacagccagaccttgaagctaggccagcgtgggtggggagggagcgagggaggagatgacagccagccctggggtcgaggggcagcccctctgagcagctggtgtgtgtgcagggaagacccccggatccatcgacacctggccagggcggcgaagtggcagcatgatcgtcattacctccatcctctcttctctggccggcctcctactcttggccttcttggcagcctctaccatgcgcttgtgagtggggacaccccctcgggcccctctcccacccagaacccctctgttgaattggtcccagtgtctggaagccctccaggcatgccatggggtttattttatttttggtagagacagggacttgctatgttgcccaggctggtctggaactgctgggctcaagcgatcctcccgtctcggcctcccaaagtattaggattacaggtgtgagccaccttgccgagccccgtggtttcgagctgggcagcgcccctcccagggcctgtgcagggaactcccaccctgagtatctcgcacctcaggggtcattgatggggccagcagcccctctgaggacaggttcgggaggtcccgcctcactcgggccctgtcttttcagtgtgtcctcagccaaggcccttctcctcccgggcctcacctgctgtctgtggatcctctggtggtttagtaagctgacgccagggtagtcagggtggccacctggagaggtggtcctccaattggttctagaagggaggaaggagggatcagagactgcaggtgaggccgggtgcagtggcacatgcctgtaatcctagcactttgggaggccgaggtgggaggatcactggaggccaaaagttcaagaccagcctgagcaacatggtgaaaccccatctccactaaaaatgcaaaaattgtccgggtgtggtggcaggcacctgtaatcccagctactcgggaggctgaggcaggagaatcgtttgaacccgggtggcgaaggttacagtgagcttagatcacaccaccgcactccagcctgggtgacagagccagactccatctcaaaaaaaaaaaaaaaaaaagaaaagagagagagagagactacacatgagggagctgggagggaggagagcaggccttgacccagcacgtgccccatgtggcagggacatatgtctcttcctcctcctctccccgcccagctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggatacccagtccccacctccatccccacctctgtctcacctgacctcctgcgagggaggctggagactgtgtggacaggccgccctgaccgcaagcttccagaccctgggaggaggcctgcagaggactgtgctttgcctgatgcagggagctgggcccatcctggggcctatgagacctgagccaccctccgtcccccatcccacacatcagtggctgggcggggtgaggattcagaggcatctctactgcccctgggcacagcacctttctgagagtgggactctccatggtcatctgactaccaattctggccaccacctccaaccctcttgtgcatatggatggctctagcccttatccaccccctcaagcatttattaagcatctgctgtatgctacatacagtgttagacttggggcttcaggcatagccggtcctgaccttggggagatgccttctctagacctgagacgaccacgtgtccagatgtgacctgttgctgtcgggggtctatcaggcccttagaccgtcaccccagtaggctctccaggacccaggagcctccatcacctggaaggaccctctgtgcaaaacctcaagcgtccatctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcaggactctaggcctccctccgccaagccagagggatgagcaatcacgcctgagagcccactgcgtgccatgcagtccgcacagccgcagcggttttctagatggagaaactgaggctcagtgacttgcccgctgcactctgtccacggccgctgcacacgcccccttgggctgcgctcccggaccttctaatgtgaccacggctcccggcatgcaggccctgccagcggagggagcccggtggtgacccttggtctgcagccctctttggaggtgaataaatgcggtctggagcccaccctggcctgaatggtgcccctgctgggacaggaaatttatgccgggagcccagggccctgctcagcttctgccccatggggttaccctgagcctgtcccttgattgctgtcccggcttgtactttgaggtgcccccatctcctaggaaaatccacacatgtgtttcagggccaggtatgtggtttaggtagtgctccctcccaagcaagcccttgagcccctcatctctggaggcttctcctccatgctgcctgcacccccaccagccaccagaaccccttcaggtatagacagaaacagattcagtcaaattccttggtgtcccaggtgacgtctggccaggggagccagcccctttaagttacactattgcatggctcacacccggaatcctagcactttgagaggctcaggcagaaggattacttgaccccaggagttccagaccagctggggcaacaacatagtgagactctatctctactaaaaatgaaaaaaaagattagccaggggtggtggtgtgcacctctagtcccagctactcgggaggctgaggcaggaggatcacctgagcccaggagtttaaggctgcagtgagccgtgatcgtgccaccgcactccagcctggacaatagagtgagaccctgtcttgaacgaacaggccaggcgcagtggctcacacctgtaatcccaggactttgggaggctgaggtgggcagatcacttaaggtcaggagttagagaccagcctggccaatgtggcaaaaccctgtctctaccaaaaatacaaaaattagcagggcatggtggtgggggcctggaatcccagctactcgggaggctgaagcaggagaatcacttgaacccagaaggtggaggttgcagtgagccaaggtcttgccactgccctccagtttgggtgacagagcaagactccgtctccaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggattacttgaggtcaggggtttgagagcagcctggccaacatggtgaaaccctgtctctgctaaaaatacaaaaattagcctggtgtggtggtgggtgcctgtaatctcagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaagatagagttaaaagaccacctccctgtcagtgacccttcagcagagactgtctcacgctgttctatccagacccaagacagttggctaggggcccggccccggaggggtatgacagggagaaggagggggccgttggtgtttgctgtgtgaaaagatgaattaatcctcccagggttcaaggaccagctaggagcaggattgccatggctttttttttttttttttaacgtggagtctcactctgttgcccaggctggagtgctgtggcgtgatctctgctcaccacaacctccacttcccaggttaaagtgattctcgagccttggtctcctgagtcgctgggatcacaggtgcctgccaccacacccagctaatttttgtactttcaatagagatggggtttcgccatgttggccacaggcttttgcatgtcctggggcccttctatgtttgttctcactgtctgaatccgtgctgatgccagacgcagcgccagggacttcccattcgagcctgcagctgcccctcccttctgcacagcctctctgagcccactgaggagctgccatcaccctcaggagccacctggaacttgactttggaaacaccctctaaacagatcttggaacctagggtgtaaagactgaatcatagtccaggagtccaggggaggctactggcccccactgagagccaagggggcttcctaggggttctttctttcttttctttttcttttttcttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttcttttcttttcttttcttttgagatcgaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttttgtatttttagtagagacaggatttcaccatgctggccaggctggtcttaaattcctgagttcaacagatcctcccacctcagcctcccaaagtgctgggattacaggtgacagccaccatgcccggccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagatggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatcttaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctaggaggcagaggttgtagtgagccgagatcacaccactgcactccagcctgggcaacacagcgagactccatctgaagaaaaaaaaaaaagaagaagaagaacccaagggagggggcactgcccagcacaggcacagtcccatcaggccctggggagccatgccagggcgttctgcccagcacagtcacacctaaaagggtcctcagccgaaccccatccccttgaataccagctcgtgacggctttgagcagaacatgtcacgggaacggcattgtgcagaactttttattaaatggcatttaaaatattccccaggactgtgtagttggggaaacaccacaaaatccattggccgggaacataatggctcaatggttcgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagagccaccttggtctcccgctgggatgtccgtggctcctctctagctgaactctccatgtccactcctgcccgtcgcccattcccctctcagtatccagagggaccaggttctttgttctttttttttttttaagatagagtctcactctgttgcctaggctggagtgcagtggtgtgatctcggctcactgcaacctccagcttcaggttcaaacgattctcctgcctcagcctcccaggtagctgagactataaatgtgcgccactgtgcctggctaatttttttgtatttttagtagacgggatttcaccatgttgaccaggctggtctcaaactcctgacgtcgggtgatccacctacctcggcctcccaaagtgctgggattacaggtgtgagccactgcacccagccaggaccaggttctaaacctgatcacatcgcacctctgctcccataacattcaggaacttcacactgcaagaacagaatctaggttcagacaggtgtggcggctcacatctgcaatcccagcactttgggaggccaaggcaggcggatcacttgaggtcaggagttcgagaccagcctggccagcatggtgaaacgccatctctactaaaaatacaaaaattagccaggcatggtgatgggcgcctgtaatttcagctacttgggaggctgaggcaggagaattgcttgaacccgggaggcggaggttgcagtgagctgagatcacaccactgcactccagcctggatgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactttaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaacatttctttagtacagaacctgctaaggccatcaaacctattgatcggaagtcagtccatcagatatgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacacctgtaatcccagcactttgggaggccaaggtgggtggatacctgaggtcagcagtttgagaccagcctgtccaaaatggtgaaactctgtctctactaaaaatataaaaattagccagacctggtggcagaagcctgtaatcccagctacttggaaggctgaggcatgagaatggcttgaacccgggaggcagaggttgcagtgagccgagatcgtgccaccgcacaccagcctgggacagagcaagactccgtctcaataaaataaaataaaataggcgtggaatagtggctcacatctataatcccagcactttgggaggtggagcagggctgatcatttgaggtcaggagttcaagaccagcctaaccaacatggtaaaaccctgtctctactaaaaatacaaaaattagccagatgtgatggtgcatggctgtaatctcagctcctcgggcggctgagggaggagaattgcttgaacctcggaggtggaggttgcagtgagccaagatcagatcatgccactgcattccagcctgggtgacaagagcaaaactccatctcaaaaaaaaccaagaaaaaaagaaaataacaaaataaaataaacctaaaaaattattaatccgctgagtaactttatgagatagaacttattatcttcattttacagatgaggaaattaaggaacaggaaatttcctttttttgagattataaagctaataaaataggatccaggaagtctggttccagaagcagttgtcttatgttttttttttttttgagatggagtttcgctcttgttgcccaggctatagtgcaacggcacgatctcggctcaccgcaacctccgcctcccgggttcaagcaattctgcctcagccttacgagcagctgggattacaggcatgcaccaccacacctggctaattttgtatttttagtagagacagggtttctccacgttggtcaggctagtctggaactcctgacctcaggtgatctgctcactttggcctcccaaagtgctaggattacaggcatgaacaaccgcgcctgtccccctttctccttactgggtatgttaaaattatttctttcaaaagaaaaggctggtcaaagtgcaacggtgttaaccactaattgatcacaaccagttacagatttttttgttccttctccactccaactgcttcatttgactagcctatggacaaaaaaaaaaaaagaggaaagaaaaagctaaactatttaatctgggctagtaaatggccagaaagggctttataaaaatgaaatatacaaatatatatatatatttttttagacagagtctcactctgtcacccaggctggagtgcagtggcacagtctcagctcactgcaatctctgcctcccaggttcaagtgattctcgtgcctcagcctcctgaagagctgggactatagcgtgcaccaccactcctggctaatttttgtatttttagtagagatggggttttgccatgttgcccaggctggtctggaactccaggcctcaattgatctgcgcttctcggcctcccaaagtgctggaattacaggcatgagccaccgcaccctgccctacatatacattttaattataatatcttttggattctttaaaaatttaaaaaaaattttttagttctttaaaaaattctttaaaacaattttatttgaagagtaataacaaaacaaatctctatttgtgaataaataaaccttgagatcatttatggttttgcaattcaacctgaaaaatgaaatcaaagcttttatcaaaacaaagcatgtttagtgctctctgtctcactgtcttttagatgccaaaccttagattttatgatgactcctcaaccgtttagatcttggttatctcagagggatcgtcagctttttaagaaagttttgagagaaaagcaagtgaagaaaagcatagtcaatgctcaacatcacgggtctctcactgaacacaccacgcctggtattctctcacagcgatgtcaccatttctacctgccacgcatcggtgaaggttgggactcgactggtgtttgatcacgatgggaaaatcatccagaaaaccccctacccccaccccagagggaccacagtcagcgtgaagcagttattttctacactacctgtgcgccataaggaatttcaaaggaatgttaagaaggtacagtaaattaatcttggttttcaagagtattggttaatgcacatgagcaaaagatttactaaagatgtttattcttcagttgattctcttcccataatctattgagaaatgctttatttgcatttctcgttaaagacttaacattaaagacttaactttagggtgatttacttttttcttttcatcacatagtgtttattaggactgggcaacatagtgagactctgtttctatgaaaaattaaaaaaaaaattgactgggcatggtggcatccacctgtagttccagctacttgggaagctgaagtgggagattcacttgagcccagaaacttgaggctgcagtgagctatgattgcgccactgtatttcagactgggagacagagtaagaccctgtctggaaaaatatatatacatatatatattttatttttattttttatttttatctttttttgagatggagtctcactttggcgccctggctggagtgcagtggcacgatctcgattcactgcaacctccacctcccgagtttaagcgattcacctgcctcagccttctgaatagctgggattacaggtgcgcaccaccacacctggctcatttttgtattttcagcagagacggggtttcaccatgttgtccaggctggccaggctggtctcaaattcctgacctcaggtgatccgcccacctcggcctctcaaagtgctgggattataggcgtgagccaccatgcctgccttatgtacttatattttaatgagactatttctcttggttttctgataaatgagttactggaacccttatgaatctgaatgcaaaagaaacagctaaatgttatgtaattgttgtgtttaaaaaccagattataaaactatctgtattatatgattacggttttataaaaacaaaacaacggcctaaatgtgtatagtataaaggctggaagagtcagcactttcatgttctcagcggttatccttggatgtgagatctcatgcactttttgctctcttctttgtgcctttccattttgtatgtgtattttttacaatctaaaaagttacttaaacatatgcagctaaaaactttttttactcgtaaagcatttgatgctaattttaactgttcttttttagacagagtcttctgactctgtcgcccaggctggagtgcagtggtgtgatcttggctcactgcaacctctacctcctgggttcaagtgattctcctgcctcagtctcccaagtagctgggattataggtatgtgtcaccatgaccagctaatttttgtatttttagtagagatagggtttcaccatgttggccaggctggtcttgcacccctgacctcaagtgatctgcctgcctcagcctcccaaagtgctgggattacaggcatgagccaccacgcgtggccttttttttaaagcttttttgcaagtcagctagcaagaacacaggaagaaatactcaaatctcccttacccagctgggggctatgtcaggttttataagcatagggtaatgagttgtgatttgattggatcttgcaataaagtaatgctgggaggtgtgatctgactggatcctgccatggggtgacagcaaaactcaatctgattggatcctggctcctgtcatggagtgtccagttcttaaatcagtctcagctcttcaggccgagcttttagttcccactccgtggtggcatgcttggttaacctgggcatgcacagggtacatgcccttcaacctgtgggtccatggcaattgaaaaacaactgacaacctcattacataaaagttgaactgagccgggtgcagtgactcacgcctgtaatcccagcactttgggaggccaaggcaggtggaggtcaggacttcaagaccagcctggccaaaatggtaaaaccccgtctctactaaaaatataaatattagccaggtgtggtggtgcacccttataatcccagctatctggaggctgaggcagcagaatcacttgaacctaggaggtggaggttgcagtgagctgagttcataccattgccctccagcctgggtgacaagagtgaaactccatcaaaaaaaaaaaaaagttgaaccagatttggtctgatgcagttacagatctacaaacctcacccccaccctcctgccaacaccttccactcctcattcttgagggattagggatggaggtcatgcttctgcttcgacttcatgctgagcagggcactgagtcccctaaagtgaaaggaatgaaactcttgggcttctgagttcaaatgagttctggggtcacccggagtagcttgaaaggctggtattgttgtaatacaagctgaaggtggaagtgttggagcctggaggacaaacagctcaccatccatttaaataaataggaccaaaaagtaacagaacagtggccacgaggggccccaacagaggaagaaaccaggtgaggtgcggtatagtggactcgactgccttctaaatctcagttgttggccaggtgcagtggctcacgcctgtaattccagcaaaagaaaagccaaggcagggtgatcacgaggtcaggagttcaagaccagcctggcaaacatggtgaagccctgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcagtcagtctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcatgcagccctcccacttcactctctctgtctctcctgctccaacatggccagacgtgcctgcttccccttcgccttctgccgtgattgtcagtttcctgaggcctccccagccatgcttcctgtacagcctgcagaactgtgagtcaattaaacctcttttcttcataaattacccagtttctcatagttctttatagcagtgtgaaaacagactaatggcccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatctcctgcgttttcagtctggcatggaaaagcccccgtgcaactggtaaagatatcaataagcaccaggaggtatctaaatccaccaggagccataggcatcacgttgacgtccatttaccagtcttccctggcaagattcttctgaattgtgctgccttgaccaaaagaggtatgggaggggctgggcgcagtggcttgtgcctgtaatcccaacattttgggaaaccaattcaggtggatcattagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaacaaaagtccgggcgtgatggctcacacctgtaatcccagcactttgggaggccaagacgggtggatcacgaggtcaggagttcaagaccagcctggcctagatggtgaaaccctgtctctactaaaaatgcaaatattagctgggcatggtggcatgcacctgtaatctcagctactcagaagtctgatgcaggagaattgctaaaacccaggagggagaggttacattgagccgagattgcgccactgcactctagcctgggcgacagagcaagactccgtctcgaaagaaagaaagagaaaggaaattccccagggaagtacctcggcttatttcataaacaggtactgaaggaagcagaggcatgtggaggacttccccacctcgtgcagctatttgggccgtggcatctgaaatttcttatttcagagtcacccctttgatgaccttggcagtgaactgcagtcatctgtttaggcctttccatggcccacgtcaatgccggtatttctgtctgttgcacatttgatttccttgttgttggcatttagaaggccccccgtttcccagatcacaccacgggcatggaccgcagagattgcatcttgtgagtctgtagaaacagtcaaggccttgtcctctcttaggtccagagctcaggttaatgcagattttcccggccatctgtgctgaagtccctgtggggaggctcctggctggtttcctgtaggtagacagctacacgtcctgcccttcattggcttctttccatgaagctcctgccatctacaaaacatgtctcccttcttgaaccacatctctgttattgaaactctagaagtcgaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggcgacagagcaagactccgtctcaaaaaaaaaaaaaaaaaaaagagaaagaaagtatcatgcttttctgcattctgtgaattgttttagtgagttattgaacttgagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatccccccacaaaaaaaaaaaaaagacaaaaaacagaattgtgtcacacaggccagatgcagtggctcatgcttataatcccagcaatttgaaaggcaaggtaagaggattgcttgagcttgagtctgaggccgcagtgagctatgaccacaccactgcaccccagtctgggtgacagcgcaagaccccaactccaaaaagaaaaaagaaaaatcacaaagaattgcatggcagagtgcctgtctttcacagctttaactgctgaaggaactttcttttttttttttttttttgagagggggtgaggagacacaatctctgctagtgattctcttgcctcagcctcccaaatagctgggattataggcgtgcaccaccacgcctgcctaatttttgtatttttagtagagacagggtttcaccatgttggccaggctggtctcaaactcctgctgggatcatgggcgtgagccaccactcccggccacctttagagttttcttaccacctggttttcctctctcaatatctttctctcatttcctgccttaaaactctagcttggcatctgggcacagtagctcatgcctgtaatcccagcactttgggaggccgaggtgggtagatcacttgaagtcaggagttcgagaccagcctggccaacatggtgaaaccttgtctctactatttttacaaaagttagtcggacgtacagacgggtgcctgtagtcccagctgcttgggaggctgaggcaggagaatttgtttgaacccagaggtgaaagttggagggagccgaggttgtgccactgcactccagcctgggagacagagcaagactctgtctccaaaacaaacaaacaaaaaaaccctgtagcttgggatcagccttctcttctattgtttttctttaaaaaataaaaattaaaaatagatgtagatgctatgttgctgaggctggcctcaaactcctggcctcaggtgatcctcccgccatgacctccaaaactgcagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccccaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaagcaaaattatacgtatgtgtatataacagttataacacccatcacacagctttatagaaacagcatctattcaaaaataccagtatttccaaaatatttaaaataatatttcaagtaataatattcaaataaataaatatatttaatatttcaataaataaaataatatttaaataattctatacccatgtttttcaaaataaaccaataaattagatagtatatattagacgtgttagtatatatatctgagacatgttaaaaatcacaactgaattctcacaattcagtcacagacctaaacagcaaataaaaatttctatcaccagaattatgtttttttctggtggggaactaccaatagctataaatagaagagattattatggaaatatcatagataaaaagagtgctcacttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacattttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtccgtaagaaacaggacctcaggttccgccccagggaggttggcattcagcaatataaaaagggtggtggtgccgcaggaaagggtggaactggaaacactcctggtttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgactgccattagcattggaataaagttcctgctgaaaatccacatctcccgtgggtccggtgttctggaagtgagagagacaatgtcacacttcaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacgactccaaaactcacttaatacacccaaggtcagccccagtgatctgcttcatagcaaggactttgggtgggtctgcccagggagtagggcaccctcagagaatgtggctttggacttcatcacagctggggccttttgtgtcacttaagatctaaacttgtaaccatgctagatgtgtttctaatgtgacaacatcacaaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcagtcataatgaacctccccaaactcagtatttatgattctttttgaggcagggtctcactctgtcgcccagactggagtgcagtggcaggatcagggctccgtgcagccccgaccttccaggctccagcgatcctcccgcctcagcctcctgagtagttgggagtagagatgcatcccacgtcgcctggctaatttttgtatttttgtggagaggggaatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacagggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcatgcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttgctgctcaggggcaccaccaggagaggcctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacattgggaggccaaagcaggaggatcacttgaggccaggagtttgagacgggcctgggcaacatagcaagaccctcgtctctattaaaaatataagaaatatgccagacgcggtggctcatgcctgtaataccagcactttagaaggctgaagcaggtggattgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctgtctcaataaacaaacaaacaaacaaacaaactgtccaggtgtggtggcacagccctgtagtcggagctaataaagaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggaccctgccttctacaggcatctagtctaatgggactgggagtaatcaaggcagatgacctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaaggagcagtgaagccgagccaggaaataccaagatggcgagccagtgtgcttgtagagattgtagagagggtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcaagtgatgcgagggggacctgaactgtggcctctgtcatgggaacccagaggaggtcgatggcgtttgtggttgatgtgggaaggagagagagagaagaaccagaaacgtctgcttgctggaggaagcggcatgtccgctcctccactccttttcttttccccttaggagcggtttatggttccttttgttttattcttttatttgtacactggcattggagtttgtttttttggctttttttttttttttttttttttttgagaaaaagtctcactctgtcacccaggctggagtgcagtggctcgaccttagcttactgcaacctccacctcctgggttcaaagggttctcttgcctcagcctcccgagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggtgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcaggatggaggggtattcgaaggtcagatgcaaatccgagaagccagaggaagggttttgggtgatgctcccaggatggtgggctccgatgggatctttggagggggtgtgtctaggtcggctggtgtcaggagggtcttttgtgtgccaggcagagaactgtcccgaagagctgagagtagaggggctaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcgagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagtgaggagaagtgtgcctcccggggggaaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttctttatttgatttttatttttatttatttattaatttattttgagacagagtcttgctctgtgggccaggctggaatgcagtggcctgatcttggctcgctgcaacctctgcctcccgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctaggatctcaggcgtgagccactgcacctggcctgaaaccaagctttcttatcccaagttctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccaccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctccccagccttgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctcttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacgcccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccgcccttccttctttttttttttttttttttttttttgagagagcgtctcactctctcacccagaatggaatgcagtggcgctatcttggctcaaagcatcctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagtctcaaagtcctgagttcaagcaatcctcttgcctcagcctcccagcgtgctaggatctcaggcgtgagccactgcacctggcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtcctcccctggtctctggctctctgagtccctccttttttgttttgttttgttttgacacagaatcttgctttgtcacccaggctggagtgtagtggtgcaatctcagctcactgcaacatccatctcctggattccatttatttttctgcctcagcctctcaggtagctgggattacaggtgcctgccataatgcccagctcaattttgtacttttagtagagacagggtttcaccatgttggccaggctggtctcaaactcctggcctcaagtgatccgcctgccttggcctcccaaagttctggggttacaggtgtgagccactgcacccagcctgaatttctccattcttcccacacaccctcctcaggttctccttcctgaccgctgacccttcttttcttttcttttcttttttttttttttttggagtgcagtagcgtgatctcagctcactgcaacctcttcctcccagtctcaagtgattctcctgtctcagcctcctgagtagctgggattacaggtgtgcaccactaccacttgactaatttttatacttttagtagagatggggtttcaccatattggccaggctggccttgaactcctgacctcaggtgatccgcccgcctcagcctcccaaagtgctggggttacaggcgtgagccaccgcacctggcccccttccttcgtcttagtcaatcctatcccacctcttcttccaccagtcccctcacctgatgatcccaacacttcatcatccaccacctcctggagggagtaccccgaggtgctccgctggggactctgctcattctgggggtgaggttgacggctggtcgtgatctttcccttaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcggggactccacatccctctgttccctgtcccagcagaggctgtgtcctctccactcaaagcctgaagcatgttggggtctcttcatctctgtacatgcccatttcagagtccaggctggtgggagaggaaacagagtgggaaagaaaactagggtaagcagaaacgatgaaaccttataagagtgagattatcatgtacaagagtgagattatcacgtacaagagtgagattatcatgtacaagagtgagattatcatgtacaagagtgagattatcatgtacaagagtgagattatcatgtacaagagtgagattatcatgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaaattttttttgataaaaaataaaagagttacatgacattcagagaccatccaaaaaacctgtgggttcccggctgggctcagtggctcatgcctgtaatcccagcactttgggaggccaaagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataaagaacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgcatattcctctctcttccggccaccttgtctagacacactacactgaggccgtgcccatcgtaaatgatgttgatatgttgtcaaaaaattggcaaaccaggcgcggtggctcatgcctgtaatcctaccactttaagaagcagaggcagacagatcaccagaggtcagaagttcgagaccagcctgtccaacatgtttaaatccgtctctagtaaaaatacagaaaaaatgagctgggcgtgggggtgcacatctgtaatcccagctacttaggaggccgaggcaggagaatcgcttgaacctggaaggcagaggttgcagtgagccgagattgcatcactgcactccagcctgggtgacagagcgagacaccatcgcaaaaaaaaaaaaaaaagaaaaaaaaaaaaaaaggctaaacagcccaggtttggtctgatatgttcagaaaaaagcaaaacagtcacctctcaccttttcttttcccgcagtgatgcagttgaatacaacaatggctgtaggtatgctgcagaaatatcattcaagtgaaacagaagggctttcctagccagacacagtggtcactcctgcaatcccaacactttggttggctaaggtaggaggatttcttgcggccaggggttcaaggctgcagtgagctgtgatccaccactgcattcccggctgggcatcagagtgaggcctgtctctaagaaaaaaacccttcactccccaaaaaaagggatttgcaaataccagcctttcagcatgaggatcacatggaggaacattaagatacagatgctgggacccagccctattgattgtaattcaaaaactgaggtggggcctgatttagctccatcattggaatccattccgatttgaaactctctgggttggacagttcaagagagatcctaaagaaagcaaaatcactatggactgaaatgagcagacaaggttttctgagcatggtgaaatatgatctgggcctcgcttgggagggctgtggccaggccttgagtccttggctcagtgggaccttctgaaacagcctccaagctgcacccctgcttcctttgcttttggatgaccccctccagcagctttggtgctgatgggaataagtcgacctgcagcggaagttcagcccaagtctcagcccagcagcctccccaaacctggccagggtctggtcatgctgccgtctctgcggttctctgtggagttgtggtttctgtaccttgaagagaacttccccttctgggacccagaaacccagtgaaccctcaggaaaaaagggaatgaaattactgaagacaactctgtggcagggagagggaaaagaggctctttgtttttgttttttattttttatttttttattttttgagacagagcttcactcttgttgcccagactggattgtaatggctcaatctcggctcactgcaacctctgcctcccatgttcaagcacttctcgtgcctccgcctccagagtagctgggacaataggcacacaccaccacacccagctaattttcgtatttgtggtagagatggggtttcgccatgttgcccaggctggtctcgaactcctggcctcaagtaatccacctgccttggcctcccaaagtgctgggactacagatgtgggccaccgtgcccagccctcactgtatggattttctaaaaaaaaaaagattacatttgtcttacttgccaaaagggaaattaaccttatctcctctcctttttaaagagtatttccttgataaaccttgtaatataaataacttcttttgtgcctttgatatgtacctaaatcttttaaaaaggtaaatgaacttcttgccaacattacaacccaggaatttttttttttttttttttttttttggagacagaatctcgctgtcacccaggctggagtgcaggggtataatctcggctcactgcaacctccacttcccgggttcaagcaattctcccatctcaacctcctgagtagctgagactacaggcgtctgccaccacgcctggctaatttttgtatttttagtagagacagggtttcaccttgttggtctggctggtcttgaactcctgacctcaggtgatccaccagcctcggcctcccaatgtgctgggattatgggcgtgagccaccgtgcctggtcacaatccaggaatttttttcttaagagcctaagagtcttgtctttgaaatgtaaacctggaggaaaatagtgtccctatcttcctgttgcctagggagtttagcctaggcaacttgagctgttactacctgcttgtcaaggagatgtgagaagttttattttttcattgaatacaggtaattaactagcatggatggccacgttgatttccaggtgaatttaggatgagtgtttaagaatgcatagcaggccaggcgcggtggctcacacctgcaatcccagcactctgggggaggccgagacgggcggatcacttgaagccacacagaaatcgaaagaaggagtttgagtccagcctggccagtatggcgaaactctgtctctactaaaatacaaatattagctgggcatgatggcacatgtctgtaattccagctacttgggaggcttaggcacgagaatcacttgaacccaggaggtggaggttacagtgagccaagaagatcacaccactacactccagcctggatgacagaatgagaccctgtctcaaaaaaaacaaaacaaaaaaaactgcatagcaagtccttttgcatgaggatgagttactatttatcttgagagcgtgtatgcaatggattgtatctgccagactatataaaaaggacgctttggccgggcgccatagctcacgcctataatcccagcactttgggaggcctaggcgggcgaattacgaggtcaggatttcgagaccatcctagctaacataacgaaaccccatctctactaaaaatacaaaaaattagccaggtgtggtggctcgcgcctgtagtctcagttacttgggaggctgaggcaggagaatcgcttaaactggggaggcagaggttgcagtgagccgagatcgcaccactgcactccagcctgggcgacagagcaagattttgtctcaaaaaaaaaaaaaaaaaaggagggtttatttctctttgcatctcattaatggatcacctgtgatgggcatcacagtctggtttaatgcttattcaataataaaattgttttctttattttctgaatttgtggagagaatattctaggttaacagaataatctatttatttacttatttatcttgagatggagtcttgctctgtctcccaggctggagtgcagtggcctgatctcggctcactgcaatctctgtctcccaggttcaagtgattcccctgcctcagcctcccaagtaactgagactacaggcgcgagccaccacacctggctaattttttgtgttttagtagagacggggtttcaccatgttggccaggatggtcttgatttcctgacctcatgatccgccggcctcggcctcccaaagtgctgggattacaggcgtgagccactgcacctggcctcagaagaatttatttttagtcttttccttaccagtttttatgaaacaactgggcaagaacactgttagatttcaccaaaaaattgtgatgaatcattgtctttatgatcccatttttgaaaattgacattttaattgtaaaccaaaaataaaattctaagcccccacaactgactcagtggactcccctgttggccaacaggatccaaaataaacatggaaaactaatttaggtcatgatgggaaggagggggttggacatgccttgtcataattctcctcccgtcagagtttaggcacagctgaccaacattatgatctctattagaatagagatcataggactgacaaaacaggctctttttatcagtaagatacccatctccaaccagactctgatatagcatcacatgacagatagcagtccctgaagtaaattacagtattttaccccaaaacatattttctttgacaaactttaaaatagtcctgcaaagccatctctttgggggaaatttgcattctgtagagaatctctttcccttacagaaaagactccaggtcttttctggagagtctgacaccttttaagatccaataagagatatttatcatctattctccctgaagcctgttctgaggcttcacctacataacaagaaccttggtttccacaatcccccttatcctaactcaaacttttctttcttttttttccctccctctttttccttccttcctctctctctttttctctctctctctttattttcttctctgttgcccaagctggaatgcagtggtgccatcatggctcactgtagcctcaacttcccaggctcaagcgatccttccatctcggcctcctgagtagctgagtctacaggcatgcaccaccacacctggataattattttttttttgtagaagtgggggtctcgctgtgttgcccaggctgtccttgaactcctggcctcaagggatcctcccagctcaccctcccaaaatgctgggattacaggcatgagccaccacaatggcccatttctttatgtagtcttccagctgttcagccaacacttaactctgaaccaactgccaatctttcaatctactagtgacctgaaagcctttcctggctgacccaacatatacttcccatgtattgatttatgtctttgcctgtaactactgtctccctaagatgcataaaaccaagctgtaacccaaccactttgggctcacgttctcaggaccccctgaggctgtgtcaccagccatggtcactcaaataggaggcccagaataaaactctttacagactttgactctttttggtcaacataacctaaccctaaacataatcctcctggggaaggtaagatcacaggtatctcttcttcgttcagtttgtatgtgtatgtccttatttctctacagtttttaggcattcgctgtgtgatctagaaaagctatggagtctcgctttgtcgccaggatggagtgcagtggcgtgatctcggctcactgcaacctccacctcccaggttcaagtgcttctcctgccttagcctcccgagtagctgggattacaggcacgcgccaccacgcccagctaatttttgtatttttagtagagacagggtttcatcatgttggccacgatgatctctatctcttgacctcgcgatctgcccgccttggcctcccaaagtgctgggattacaggcttgagccaccgcgcccagctacaaattctattttctttttgttccttggaaagcatcgctgggcatttatcctgtcccagtatttgagtgaaacttctcagcatttcagagcagtgaccatgatacaccctttcctttccttctccttatggcaaactcggttctaacccagaggacttgggctccaggacccagtaacgcagccctggacttgaccctaaaagggagtaaagacaaaggtgaagttcagtccggggttcagggctgccaaagctcatagcctggagcttcttaacctttaggcggggtagagacatttaagacagcccctaaacttggggagcgcgtaggctcatgggaaatagagtctgttacttgtcctgggaccgcggtgggtgtccggggaggcggacttccggtgcactcctgcgcgtgtgcacctctccctgcgtgcgtgttcgcgcgtgcgtgctcgcacatgcgcgccacctccgcactgccctcgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtgagccccagggaggcggatctgggccccgagaaggacacccacctggatttgccccataggcccggcccgggcccctcgggagcagaacagccttggtgaggtggacaggaggggacctcgtgagcagacgcgtgcgccagcgacagcagcccgccccggcctctcaggagccgtggggcagaggctgcggagccccaggagggtaagtcttgggtttttgggcccggagcgagaagggcctgggtgaagtcaccgtgttttggggaccttagagtgtggggcagagggagggtcccgattgcttgctggagagacatgtgttgggttcgagggcagggtccggctgcaccgaacaggcgctgcatgggaagatctgggaggacgaggcttagggaggcgtggagggtgtcaccaccctcagctgcggacgtcgtctccactccccgctaacccctaacagtccttcctcctcctctccgtgctccagatttcgaccgcctctaaatgtccgtcagcacttctattctctcacttaagtgtctgctgatcccccccttagatctgccctgggagaatcgtagtaatgcaggaacagtctgcagggattctctcctgctgcctcagttgctaggggaagagactgggccttagcaggtgggtgacttgaccaggtcaccggctttgtgggtagagctgctcatagtagaacccaggagacttatctcccaggccagtgttatttctcccgtatcctagttttcttaatagaagattattaggtgccacaataactaagttcagttagataatttagaaacaaaaccatattttatacacattcatttcatttctgagagctcacctactcaattcctatggcctattttattttaggcagtttaaagagacaataagaaaatgcgggcgggatgcagtggctcacacctgtaatccgagcactttgcggggctagggcaagagtatcccttgagaccaggagttagagaccagcctagacaacatggggacaccctgactacaaaaaatacaaaagtcgccaggcatgctgggatgcatctgtggtcccagctactcaggaggctgaagtgggaggatggatggagcccaggaggtcgaggctgcagagagccgtgaatgcaccactgcactccagcctgggtggcagattgagaccctgtctcaaccaacaaaccacaaaaaacatgagccgtataatgggaattttttttctttttgcaccttgtatttgatgatggcagactatttgtaaaaggagtcgtgttacccatgagagtctaactcatctaattactacctgattatcttagagttacaggcgcatgcttcccctatcactttttttttttttttttttttgagacagtgtctctcacccagtctggaatgcaacagcgtggtctcggctcactgcaacttccacctcccaggttcaaaggattctcgtgcctcagcctcctgagtagctgggactacaggcatgtgacactatgcctggctaattttttttgttatttttaagtagagacggggttttgccatgttggcccaggcaggcggatcacttgaggccagaatttgagaccagcctggccaacatggcgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcaagtttccaagagcagcagaaaatgaacacattgcaggtgagttttcctgcttgtgtatatgttcctcaattttattttatgatgcattttaagaggtttgtaaggattcatacttttttttttcttttttttgagatggagtcttgctctgttgcccaggctgcagtgcagtggcatgatctcgcttcactgcaacctccacctcctgggttcaagtgattctcctgcctcagcctcctgagtagcagggattacaggcgtgcgccaccatgcccagctaattttttgtatttttagaagagatggggtttcactatgttggccaggctggtctcaaactcctgacctcaggtgatcttcccacctcagcctcccaaagtgctgggattacaggcatgagccaccaagcccagccaggattcatactttaaaatgggaatgtggaaatagacattatcctgtaaaatatagttagtgtggcagatcagcaccaaaaatgatttgtgaagcttgtatgtatgggtagtatattttaaggctgttgaaattgagccgcacctaggactgatattcttggcagtcatcacaaaaggaaagtgccatctgtattagtccattctcacactgctatagagaaataaccaagactgggtaatttataaagtaaagaggtttaattggctcacgtctgcaggctctatcataggaagcatggctgaggaggcctcaggaaacttacagtcaggtgaaaggtgaagggaaagcgggcgcatcttccatcaccagagcaggaggaagagggaacactggggattacaattgaacatgagatttgggaggcaacacacaccgaaaccatatcaccatccatgacatcgtttgcattgattataaggagaaaccagttttgttacttgtggatttaaaagattttctgggacttggaaaaatttcttcattcaagttggtgtaattgtggatagctttcctaacaacaaccattaattactgtaacttatggcttattcttggtgcttatgtaagcagagggcctgctgcccaaggagaacttggtgcatataatttttccagggacggaaatatcgtgatccaagtaaacaattctgtttttactgttgagtcctagatcatggggggaatgaatgacgtgatcatccgtcaaatatttgttcgtctttttgttcgggttgcacagcaaacaatacagacagttactctcttgtgaagatttcctcatttctgtttctcatttcacttctcagtgttttcgttttgtcctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgaaatttaactcatctttcttatgtgactctaaaggtcaaaccataccacctgaatatttttatcctctctgaatatttccattaaagagtttatttaaaagaatttttaaatcttctcattatgtcttaacagcatgatatcatactctactttttgacttctccatttgatatggaataaaattgcatcatatggccaaggcatatacacttaaagtcttcaatttagaagctttccagagtcaaactgagtcaatctctgctttagaagtctcccacaaaaaggatcctacataaattactgtgtgtttaaaggtttctgattttaatctaataactgaaatatcaaactatattttaattcaggcatttgggcatcactaccacgtgttctcatcagatttaggaaccctgcagcaagatttatcagtgtcaaaatgctaaaatcctaaatttagtgccagaatccctctcaaatggcatttatattttgatagcttaacctactttgaatcccctgagcatcttgtctgtttttattagtagattttgctgatcttttttaacttttcaaaggctctttaaattatcctaaagtcatatatttaccatgagaaagcaggtgtctttttagagtgtagatgcttaagtcgctcataaaattaatttcctcgggttaggagaacattttgaaactctaatttgaaaaactctaatctggcttctaaaaacactgtatcagtattcagaaataataaaaatggaaacataacaacataataaatttaatttaacctagcatagcaaaagagtagggcatttttgcataatcagctagatagttttcagaggcaaacacagagcagtggagactttgtttggagacagccattgtttcaagaaatgggtgttgccttgatgaagctacccttgcttgtcactgcagatccgtctcctgctatcaccagctctgtgtaacattgcctatgctgtggacacacagagatacttgacagtcagtggatgaactcaataaatgttattatttttaaatacacagcttactaaacagataaataatcttaaaattgagactgttccagaaaccagaatgcattttcttcatactcatagcttttgtggtttacatacatttatataattagaatgcaataaaatacattaaacagtaaaataatactctatataatttaatctctggggatccagaaggcactttaagctattacagtttctcagagtcaatgttatgtactttataattttttattctactggtaaaacatggtgatattgattaacagatattttagtagatataatattttataaactgattttattatgtcttgttaatattgggataatcagaatatagagagacttctatacatacacatatattctatatcttcatagctagacttgaagtatctcactttgatgtttctaaaaataaagtgagcacttttgttctttttaatattttatttatttatgtatttatttatttatttttgagacgcagtcttgctctgtcaaccaggctggaatgcagtggtgcgatctcggctcactgcaaactctgccttcctggttcaagcgattctcctgcctcagcctcctgagtagctgggattacaggctactaccaccacgcctggttaattttattttgtgtgtgtatttttagtagagacagggtttcaccatgttgcccagtctggtctcgaactcctgacctcaggtgatctgcccaccttggcctcccaaagtgctgggattacaggcatgagccactatgcccagcccactttgtccttcaatttcttccttcttcttcattttgacccccagtttacatcattaagtacatagtctcgaaacctcaaagtatcagtgttatccttatttttttttctccttctctgaatttgcctgatagtcaaaacctgtgcctactaccacttaaaggttttttttttcatctgtctgactagattgtccactgtctcaccaaatcttgctttgactagtaataatggcagttgagagtactgcctatcacttgaccagactagctaaatgctgaacattcattataatatttaaatctttaaaccaaccttgatttttattttgatttatgagatgactctaccaaaggttagattctgattttggagagctagatcataatagagtcagaattctgttcttaacttctacactgtactccaacaacagtcaaactgttactttctcattcagggtaaaatcctgaccaaacccattactgaaaaccttccttttttatctcagctcccagtctccaccccatgtatctgatacacctgtgacaatgatcttttctccatatctagaaaatatcaccaacttacagtgccgtgttatggtataggctcttatttccacttcctttcatcacagttctatttatttctcaatacacagttgaagatcagttgaaatatcaatttcagcataacttcccatacttgggcataatttaatagcttaccagacagtagcatataatgtagtgacttgggagccagacttcctgggtttgaatacgggatgaaaattcaccagtcttttgaccttgggaaagttactaaaccttcctatacaccagtttcctcatccgtgaaatgaggcaaattatagcacctacctcttagggttgttataaaccttaaatcagttagtacaagtaaaggccttagaacagcacctggcacattgtaagaaatgtctaaaggttcattgctatcatttattcatttccacatctcattcctaaaataaaaggtgttataaaattgccagtataattagaaaaaaaatgggaaaatgtgttaaagaaaaattataaacaaaattgaagaaaatgtagaataatacatatatatcttaggaggaaagctcttaagcatatagaaaattaagaaactatgaaacaagattaacatagttgactatacacaaactttaattgctaatacaggcatactttgttttatgctttgctttattgcacttcacagaatttttttagaaattgaagttttgtggcaagcttgcatcaagcaagtccatcagcaccattttcccaaaagcctgtgctcactttctgtctctgtgtcatatttggtaattctcacagtatttcaaacttttaaattattattatatctgttatggtgttctgtggtcagtgattttccatgttactatggtaattgctttgaggcatcacaactcatgcccatataagatggcaaacttaattgataaatgtgtatgttctgactactccaaagactggccattccccatcttccttcccctcctcaggccaccctactgcctaagacacaacaatatggaaactaggtcaattaataatcctccatggccctctaaatgttcaagtgaaaagactaatgaagaaggcatgttgaaagttgagataggctaaaagctaggcctcttgtgccaaacatttagcaaagatatgaatgcagagaaaaaattcttgaaggaaattaaaagtgctactccaatgaacacatcaatgataaggaagcaaaacaggcttattcatgatatggagaaagttttagtgatccggatagaataccaagccagccacaacattctcctaagccaaagcctaatccagagcaaagccctaactgtcttcaattctgtgaaggttgagagaggtgaggaagcttcggaagaaaagtttgaagctagcagtggttggctcataaggtttaagaaaagaagctgtatctgtaatataaaagtgcaaggtgaaacagcaagtgctagtgtagaagcaggagtgagttatccagaagatctagctaagataactgatgaagatggctacattaagcaacagattttcaatgtagacaaaacaacctatattgaaagaagatatcatctaggactttcatagtaagagagaagtcaatgtctggtttcaaagcttcagaggacaggctgatgtgattcttaggggctaatgcagctagtaacttctaattgaagccaatacttatttgccattccaaaatccctatgacccttaagaattgtgcaaaatctactctgcctatgctttataaatggaatgacaaagcctagatgatagcacggtatacaaatattttaggcccagtgttaagacctactgctcagaaaaaagatttctttcaaaatattattgcacattgacaataacttaatcacccaagagctctgacggagaggtacagggagattaatgttttcatgcctgctaataaaacatcaattgtgcagcccatggatcaaagagtaatttttactttcaagtcttattatttaagaaatatatttcataatgctatatttgccatagatagtgatttccccaatggatctgggcaaggtacattgaaagccttctggaaagggtttaccattctagaagtcattaagaacatttgtgattcatgagaacaggtcaaaaatcaacattaacagaaatctggaagaagttaattccaaccctcatagattactttgaggggttttagatttcagtggagaaagtccctgcagatgttgtggaaatagcaggagaactagaattagaagtaaagcctgcctgggaggggaaggacacgcaccggagcctgttaggggatgggaagtaataggagggagagtattaggaccaatacctaatgcatgcggggcttaaaacctagatgacaggttaataggtgcaggaaaccatcatggcacatgtatacttatgtaaacaatcccacactttctgcgcatgtatccaggaacttaaagtaaaattaaaacaaacaaaaaaagaagtaaagcctgaagatgtgactgaatcactacagtctcatgataaaactttagcaaataaggagttgcttcttatggatgagcaaagaaataagtttattgaaatggaatctattcctggtgaagatgctgtgaacattattgaaatgataacaaaattctagaatatttgataaactttatcagcagcatcagaatttgaaaaatttgacttgaattttgaaagaggttctactgtaggtaaaatgctatcaaacagcatcacatgctatggagaaatctttcatgaaaggaagagtcagtagatgtggcagacttcattgttgtcttattttagaaattgccacagccaccccatccttcagcaaccaccaccttgatcagtcagtagctatcattgtcaaggcaaggtcctccatcagcaaacagattaagactggcttgaaagcgaaagtgatcattaacatttcttaataaaacattttcattaaggtatgcattttattttttagaaataatactattacataattaatagactatagtatagcataaacataacttttatatgcactggaaaaccaaaagaatcatgtgacctgctttattgtgatatttgctctattgcagtgatctggatccaaatttgcagcttctgcaaggtatgcctgtgtagggaaaggcagcacaaactaaactacaatagaagcgacagagcacagagcaaaagagtatacttttaacatatgtgttaaataaatgtttaatacacacatcaaatacagaacctctagaagtcaatataatttaaaatgcaaacacataaaataataagcaaaactctaaatattcaacataaatgatataaaaatgtcctataaacctttaaaaatacttatttaaataacctgcaataactttgccccttaaatagggtaaatttatatagatcagcactaatttaattttggcatgtatttgaagaaatgataaatattacacattgtttatgatggtataaattgcaatattattaaaaggatacatggaatctattaaaatttttggaagtggatatatcttttgattgatttgattgatacagcagttcgtcttttgtgtgtcttatacacacatatacataatatacacttaggcaaacacatttcagacatttggattgggatcctggctgctgcttcaacctcatctaatttcctattacacctcctctctctccctttttgtacatttgtccctctctctgatttccaccatctgtctttccagtttactttctctagttccagacaacaaaaattctttaatcccactgggatctccaatcaattgattcaatcaacttttcattatgcctcaaccctttgatcttctaatctaacttctcataactcaagataaattccatgggaaatccttaacaatcacttccacatatacatccttaactgcctgcctccctcttattgcttttacttgtttggaaaaaccacaacttggttaaatccagatcaccattctctatgtctataattctgcagctaaacataggtagagatcaatacacaaccatcatttctcatcttaaattcataaccacaaacctcatagagatctgttaatgctagtcaggcaattacactgtttcccattcctttaattccttcactatcctgtttcaatttcacacctttttctgctttcttatatgtaaaacacctcctccctgtccttactttcaagtgatcactgtacatcttatttcatgaagaatattcaaatgattaaaagaaaacatcacagattcccatcaccacgtctgcccccacaccgtttacaaacccacactccctgctgcccatcttgttgccccgggtgaactatctgaactactatctaaagtcagtttcttcccacgtgcactacattccagcagcttttacttagcaaagaacattttccagcaatttccttatctctccttaacaccattttctccccttttcctactggatcattctcatcagcatgtaaacaagttattacttgtttcccaacctgaccacatttttcatcttccgtctccgtaaatctgatctgtgccccactatttatttcctgaatttctatgatggccttttacctgatcttcctgcatgtgtcctctcaccctacacaatctattcccagcatggcagtcagaaacaaccttttaaaacagaagccaggtcttgcgcctcctattctgaaatcctcactggtttccccccaccccacccctcatgtcactcagagtaaaccctaacttcgcatgtgcctgacagggtcttacataacctacccgcccccacagcccagacctctctgatcttctggaccattgttgtcctcattgatcactctgctccagctacaactgtctacggctctccctccaccttcccaactgaaggcttttgtgcttgttgtttctatcctgaaaatgaacttctataatgtggttaactttcccttatctcattcaagtatttgctcaagtctttttcagtaagacaggccctaatcatcttatttaaaactggaacctacactcccactccctacacttctgcacccatttactttgctctgctttttcttttttcatagaatgtgtcacattataatactatatagttcactttttactatttatcattttattacctatcccagtcattacattttgagattcaggagtacaaaaatctttgactcttttgttcactgatgaaatcacacacacacaaaaaaaccataaactataacctataaaaaacctataaactataaaataacctatagaaaaacatatgatcacaaaaaaacctataacctatcagcaagaaaattggcatcaattaatacttgctaagtgaattaatgtatttgtgcaaaatatatatacagaagcatgtctggtgtatccttgttttattttttatttttttatttttttcaattttaactattattaacgaacatttatacatttatatgcttttctattttctacactattataaataactgtgatgaatatctttgtaagtctttgatgatacatgtgatgatttccttaggacagattcttagaagtggaattcctggatgcaagaacatgatttttctttttctttctttctttctttttttttaattttatttttattatttttttattttattattattatactttaagttttagggtacatgtgcacaatgtgcaggtttgttacatatgtatagatgtgctatgttggtgtgctgcacccattaactcgtcatttagcattaggtatatctcctaatgctatccctccccccttcccctaccccacaacagtccccgacgtgtgatgttccccttcctgtgtccatgtgttctcattgttcaattcccatctatgagtgagaacatgtggtgtttggttttttgtccttgcagtagtttgctgagaatgatggtttccagtttcatccatgtccctacaaaggacatgaactcatcattttttatggctgcatagtattccatggtgtgtatgtgccacattttcttaatccagtctattgttgttggacatttgggttggttccaagtctttgctatagtgaatagtgccgcaataaacacctgtgtatgtgtctttatagcagcatgatttatagtcctttgggtatatacccagtaatgggatggctgggtcaaatggtatttctagttctagatcgctgaggaatcgccacactgacttctacaatggttgaactagtttacagtcccaccaacagtgtaaaagtgttcctatttctccacatcctctccagcacctgttttttactgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttctcccactgtttgatggggtggtttgtctttttcttctaaatttgtttgagttcattgtagattctggatattagccctttgtcagatgagtaggttgtaaaaattttctcccagtttataggttgcctgttcactctgatggtagtttcttgtgctgtgcagaagctctttagtttaattagatcccatttgttgattttggcttttgttaccattgcttttggtgttttagacatgaagtccttgcccatgcctatgtcctgaatggtattgcctaggttaccttctagggtttttatggttttaggtctaacatgtaagtctttaatccgtcttcaattgattttcgtataaggtgttaggaaaggatccagtttcagctttctacatatggctagccagttttcccagcaccatttattaaatagggaatcctttcccattgcttgtttttgtcaggtttttcaaagatcagatggttgtagatatgcggcattatttctgagggctctgttctgttccattgatcaatatctctgttttggtaccagtaccatgctgttttggttactgtagccttgtagtatagtttgaagtcaggtagcgtgatgcctccggctttgttcttttggcttaggattgacttggtgatgcgggctcttttggctccatatgaactttaaagtagttttttccaattctgtgaagaaagtcataggtagcttgatggggatggcattgaatctataaattaccttgggcagtatggccattttcacgatattaattcttcctacccatgagcatggaattttcttccatttgtttgtatcctcttttatttccttgagcagtggtttgtagttctccttgaagaggtccttcacatcccttgtaagctggattcctaggtattttattctttttgaagcaattgtgaatgggagttcactcatgatttgactctctgtttgtctgttattggtgtataagaatgcttgtgatttttgcacattgattttgtatcctgagactttgctgaagttgcttatcagcttaaggagattttgggctgagacgatggggtctgctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagacacgtcccatcaatacctaatttattgagagtttttagcatgaagggttgttgaattttgtcaaaggccttttctgcatctattgagaaaatcatgtggtttttgtctttggttctgtttatatgttagattacatttattgatttgcatatgttgaatcagcctttcatcccagggatgaagcccacttgttcatggtggataagctttttgatgtgctgctggatttggtttgccagtattttattgaggatttttgcatcaatgttcatcaaggatattggtctaaaattctcttttttggttgtgtccctgccaggctttggtatcaggatgatgctggcctcataaaatgagttagggaggattccctctttttctattgattggaatagtttcagaaggaatggtaccatctcctccttgtacctctggtagaattcagctgtgaatccatctggtcctggacctttttttggttggtaagccattgattattgccacaatttcagagcctgttattggtctattcagagattcaacttcttcctggtttagtcttgggaaggtgtttgtgttgaggagtttatccatttcttctagattttctagtttatttgcgtagaggtgtttgtagtattctctgatgattgtttgtatttctgtgggattggtggtgatatcctctttatcattttttattgcgtctatttgattcttctctcttttcttcattactcttgctagcggtctatcagttttgttgatcttttaaaaaaaccagctcctagattcattaatttttgaagggttttttgtgtctctatttccttcagttctgctctgattttagttatttcttgccttctgctagctttcgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttttgtctttgttctcgttggtttcaaagaacatctttatttctgccttcattttgttatgtacccagtagtcacttaggagcaggttgttcagtttccatgtagttgagcagttttgagtgagtttcttaatcctgagttctagtttgattgcactgtggtctgagagacagtttgttataatttctgttcttttacatttgctgaggagtgctttatttccaaatatgtggtcaattttggaataggtgtggtgtgctgaaaaaaatgtatatcctctttatttggggtggagagttctgtagatgtttattaggtccacttggtgcagagctgagttcaattcctgggtatccttgttgactttcagtctcgttgatctgtctaatgttgacagtggggtgttaaagtctcccattattattttgtgggagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactaggattgcaacccctgcctttttttgttgtccatttgcttggtagatcttcctccatccttttattttgagcctatgtgtgtctctgcacgtgagatgggtttcctgaatacagcacactgatgggtcttgactctttatccaatttgccagtctgtatcttttaattggagcatttagcccatttacatttaaagttaatattgttatatgtgaatctgatcctgtcattatgatgttagctggttattttgctcgttagttgatgcagtttcttcctagccttgatggtctttacattttggcatgtttttgcagtggctggtatcgtttgttcctttccatgtttagtgcttccttcaggagctcttttagggcaggcctggtggtgacaaaatctctcagcatttgcttgtctgtaaagtattttatttctccttcacttatgaagcttagtttggctggatatgagattctgggttgaaaattcttttctttaaggatgttgaatattgatccccactctcttctggcttgtagagtttctgccgagagatccgctgttagtctgatgggcttccctttgtgggtaacccgacctttctctctggctgcccttaacattttttccttcatttcaactttggtgaatctgataattacgtgtcttggagttgctcttctcgaggagtatctttgtggtgttctctgtatttcctgaatctgagtgttggcctgccttgccagattgggaaagttctcctggataatatcctgcagagtgttttccaacttggttccattctccccgtcactttcaggtacaccaatcagatgtagatttggtcttttcacatagtcccatatttcttggaggctttgtccgtttctttttattcttatttctctaaacttcccttctcgcttcatttcattcatttcgtcttccatcgctgatacccattcttccagttgatcgcattggctcttgaggcttctgcattattcacgtagttctcgagccttggcttttagctccatcaagtcctttaaggacttctctgcattggttattctagttatccattcatctaattttttttcaaagtttttaacttctttgccattggtttgaatttcctcctgtagcttggagtagtttgatcatctgaagccttcttctctcaactcgtcaaagtcattctccgtccagctttgttccgttgctggtgaggagctgccttccttgggaggaggagaggtgctctgctttttagagtttccagtttttctgctctgttttttccccatctttgtggttttatctacttttgttctttgatgatggtgacgtacagatgggtttttggtgtggatgtcctttctgtttgttagttttccttctaacagacaggaccctcagctgcaggtctgttggagtttgctagaggtcactccagaccctgtttgcctgggtatcagcagtggtgactgcagaacagcagtggctgtagaacagcggacattggtgatccgcaaatgctgctgcctgatcgttcctctggaggttttgtctcagaggagtacccggccatgtgaggtgtcagtctgcccctactggggggtgcttcccatttaggctgctcgggggtcagggacccacttgaggaggcagtctgcccgttctcagatctccagctgcgtgctgggagaaacactactctcttcaaagctgtcagacagggacatttaagtctgcagaggttactgctgtctttttgttcgtctgtgccctgcccccagaggtggagcctacaaaggcaggcaggcctccttgagctgtggtgggctccacccagtttgagcttcccagctgctttgtttacctaatcaagcctgggcaatggcgggcgcccctcccccagccttgctgcccccttgcagtttgatctcagactgctgtgctagcaatcagcgagactccgtgggtgtaggaccctctgagccagatgtgggatataatctcctggtgtgctgttttttaagcccattggaaaagggcagtattagggtgggagtgacccgattttccagttgccgtctgtcacccctttctttgactaggaaagggaactccctgaccccttgtgcttcccgaatgaggcaatgccttgccctgcttcagctcacgcacggtgcactgcacccactgtcctgcacccactgtctggcattccctagtgagatgaacccggtacctcagatggaaatgcagaaatcacccatcttctgtgtcgctcatgctgggagctgtagaccggagctgctcctattcggccatcttggctccaccgtatccttgttttaatagaagaaaactgtataatatcaatattggaatggttaaatactgttttactcattatattgatattatacattcattagaagatgacttaattagccaggtgtggtggtgcatgactgtagtctcagctactcgggtggctgaggtgggaagatggcttgaggcaaggagttcaagaccagcctggacaacatagcaagaccccatccataaaaaaaattcccagactgacaaagaaacttaaaaaataaaacatagactaggatctcattaacaaattaacattatatatatataacagatgtgaaataaactaccagaaagattctcttctacatcatatgtcaccagggaaatgtgagttaaaacaatgagataccactacctaccaattagagtggtcaaaatccagaacatgctgtggaaaatgtggagcaccaagaaattttatccattgctcatggggatgcaaaatggtacagccacttaccaaactaagcatactttgaccatactctccagcaatcacactctttggtgtttaccctaataaactgaaaatttatgtccacataaaaactggcacataaacatttatagcaggtttattcatacttgccaaaacatagaacaaccaagatgtccttcagtaggtgaatggataaacttggtacatcaggacagtgaaatattattcagtgcttaaaaaagaaagaaagaagccatcaagccatggaaacatctagaggaaacttaaatgcacattactaagtaaaagaagccaatctgaaaggatatatactatgtgactacaactattagacatgctggaaaagacaaaagatggagacagtaaaataattgattggtagttgccagggttagggggagagagggatcaataggcagagcacaaaggatatttgtggaggtgaaactactctgtgatattacagtggtggtacatgtcattatacatgtgtccaaacctacagaatgtacatcaccaagagtgaaccccagcgtaaagtaggaaatgtgggtaatgatgatgtctcaatataggtttatcaactgtaacaaaagtatcactctggtgaggactgttgataatgggggaggctgagcatgtggggcagcaggggctacaagggaactcttggtattttctgttcaattttcctataaaactaaaacttctctaaaaaataaagtctattcaaaattatatatataatatatttttctctttataaacagacactgtaagaaacatcaaaactatttgtaatagcgcatacggttaggcaggagaggtttgacaaagtagagaagggtaaaagtggaatttttaattgattttaaattgtttgaattcttaaaatgatattcatttatagtgttgatacatttcaaaaataagaaaattagggcaaaggaaaaataaaatagaaaaagtacaatgaaatcaagagtaacattaatacacaagacatgcatatagaattctctacattttctaactgtgagtcataaaatggactctgatcttttctgccaacaatgaccagttaaatcatggtgttaacatgatagaaaacaaacaaattattcaggaggtacacattattcctggcatgagtacctaaataaaaaaatctattctgtgtctctattgagtgatgtttgagcagcaactttaatgctatctttatagcaactcaatgcatttcattgaggtttttctttgtaaatgttcatgtagactgccaaagtgcagcttgataatacctgtcttgtaggtcttgaagttttctaggtaggaactggcaatgggccacaaaacaatgtgatcataaaacatggctctgctatggtcttgtttattccaaaagccatatttagagtgtcctaaactaagctactattttttattctgcaaaagtagattctttcgtcaaatatttcagaaaatttatatcaagccaagttagatgtgtttctttgcctttgggacttcttagagcctttaatatgcaaatatgcattgtaaatctttaagagtgagacagaaaatattgtgtttgtcaagcaaaattaagtctgggagcctatttttgaatgagtgtctccagggctttgattccatagagcacacgtctggtaagcagtatggccagatggctcctccttttaggtgagtctctacaaatagggttttgttattgtggctcttttctttcagtgaggaattgataggccttctcgtgatcccagattttatttgtaggtctattattgtatttcctatttttgctgaatttgatttttctttaccaatttctctaccactttggaaatgcatcaagaacagtttttgttacctcagtacctaataatgccagtgcctagctcagtatttattaactatttttgaaagaaaaactaaacatagcattttcacaggaagattataaatccatggagcattacagatagttctaaggtattttaaatattccaaggctatgcggaaagttaaatgacatctttgttgctgaaattataccatcccaacatgttaataatcatgctgatcagtaactgtggtttggtagttgtagatgtctttatagtagttggaaaacaaattaatagacatagtttgtttaataatttttttcaaatttgtagttagaaaaaatgaaaatacttctgattgtgaaaaaaatgttgaaaaatgtattcagctcctttacagagaggaaaactaaggctaatgtggtaaaagagacttgcctaatatcacacaaaccctttagagcacagtaagtattaaaactcatacttaatcacttccatgcagtaggttttctcttttctagactctcccttttgcaagtttaatggtaacatttctctttctccttgtcttatctcctttcttttatttacatagcatgtgacattctcttgcatgtttcaggtatttttgccatctcaggactgagaggccctggcaaactggcagttgggtaagctgcatttcccctccttaattgatgggaagcactgcctttgacagagctgattcacagtgatggggctgactggctgaaaactggtaggaggactttgcaacagctctgggccaaaccgagtccacaggccatatgtctgcctcctccgtcataaacagacgaccaagtgtgcacactcccaagtgtaatgtcactgggaccttatttgcaaacatataaacgaatgacattcaattatgttcagaggcaatgttgtcaaaaccaccaaggaagcaatttactgctcttgcacagtatgtgactcacagtgcattagcaagttttcattgcttagtttgttcaatatgtttctgaagcagttcttttgcagcctgttgtgtaaccatgatacacacacttatatagcatacatagataggattaaattaagggttgttacagaattatgtcaagtgaaaaaaatgtataataaaatcggctaatttctttgtagacattggccaattaaagggagaaaagcacagtttctacaactagtggagtaaagttattagttgataccaatggatattagcagaaaattgatgaaaggttttaaatttttggctctatgggattccatttttgctaaatgatataatattctcatggtaggaaaaaagttctctgatttacataaaatgcgggtatagcaaaagcaatggtattttaacttaacaacagccctcaaaacacccttataatgttcttggaacaaatgctgtaaaagctgaaagggttcattcctaggtgttcctattggcactattactagtgctaatagaaagcacccagaaaactgaatcagggagataaactataccttcacacaatacataacaacagtaataatcatagtactttgcattggcattatgttttacagtgtacataaacatgaagtatgcccttgaacttgagtatattacataaaacacagatggagtgggcagcttcaaaggaagtatcatcattatttatcatttttgtctttctcatttccaaggttagaaaactgagatttagcgaagttatatgacttatccaaggctatatctcaatactattggaatcaaaagtagatgtggctgagtcttctgaattctagggcaaagtgttttctcaagtaatactgtctcaactgtcaagagtacagttctaccttataactgaaactatcgtaggtatcagaagagggactatatcaggagggcaggcggaggagctccatcatgatggtcctaaaccttgaaagatgggtaatgcttaactaatacaagaaaaaaatgaaagaaattctgagcaaggcaacaccttggataacgattagaaaattaacatttgttgactgatttaataagtattaagcactcataagcaccagctagtgttctaggtactgcgatttggcattgagcaagagacaccatcttagtcttacagaatctatgctataagtggaatatggacccttagaaatgaataacaaaatttaaaaattattttaccttctgttaagaaaatagagtaaatgggttgaaagtggtagagggaaggagtatttcaggccaagtcgtcagagaaggccgctcttaaagatgaccttggaggagacacctgaatgataaggaatgttatcatgcaaatgtccacggaagcattttctggtggatgagaccagtgatgcaacctgggaacaaatttctttctaagtgtgataagaagactttaagaggttctatgtactttttgaaaagatcattattcctgctttctttcataagtccaaaagaggtcatgaatggaaacaggaagagcaggattttttggtagttcatgatatgtaggagaggtttactcagagggagaaagggtgaagtgagagatcaaagcaaaatcctaaatttttggcttgagtacttgaacagatgagataaagaagggtatgaacataagtaggttgtgatgctggccctagttactaaaagggtgtgtatgtttatgaagtagaaaacaacagctggctccatcagggctgtgagtttaatgcagttggactcctcagactgggccgtgatgaggcacggtatagaactgagaagaaggggatctgcaactcagccacaccttctaaaccaacaccccaatctcattttcattgtctgtaaaatgaggggttaggtcacgttgacaaaatttagctaattttaggctctgaactccttttaagaatctaatcattactaacgattctccagaaaacgaaattgaacatatgtttaaaattcccaggcaacacagagacttaagaacttcttggcttgaatattatcaaggattactccagttcgaagtgtttgattctatacaataccaaaataagtcccaaattatagtgatctaacaaaaccatatgtgaccattgcagtgtggcagagagttttgctgcaagtttgcccacgtatgtgaactgatgaagaccttcatcttgtagctgcaacatcaggaatattcagcctctttcttcattgcatagtgagagagagaaccaaaaaccacatagggagttttcactgcctctgactggaagtggcatgcattcctttgaattttatattattggccagatcttatcacctggcacttggcccctaactgcaaatgggatagaaaatagaaaagagtatatttggtaaacattatatattctctttcacataagctttctccttacacagatattttcatagctcaaccagaaacttttggttaaataagcatagacttgtctaaataatggaatactatgaagctgtcataggtttgtaaagattgctaaggcataaaagtctatttaaaaaaagtacaaagtagtgtggatagtctgctgccactcatgtaagaaagaaggaaaatgagaatttatgtttgtatttgtttgcatttggatagaaaatctccagaggataagcttaaaagtgagtagtgatggtgatgggcctcttggatgggaaagatgagagagtgagagcaaaacttttcatagtatatggtctcatattattttgatttttatatgaacattctcagtaatggagggcatcaaaatatcagtggctaattccaaagctcctgctattacagaatgacagcatccgatggaggaggatgttcatgtatcaccaaacagctcaagcatggcttcattgcagtgtaacatgcatcatgtcatgtgttattgcttacttaacaaacctcactctatcccacggattaatcaagataaagtagctaaatattgcctgtctacagatgaggtttccatttgtcaaaaggagatataaaactaagtaaggaattggtagattttctcttcatccactctcagtgctaatataagaacttaaaggggattttttggccgtaattcaatatgacattaatgttagaaaattattcacctaaatgaacaaaaagttttccaaagtaaaaaaattatcttgataatgtaaatttatatgctattcaaacttgaaatgcatgaaacaatttttatggtagtatactttattatgaatcgtttataatttttgaagcaaaaacaatgtgaaatcatagtaaatagtataagatttggaactagacagatataaattcaaatcctacctctactaattgtgttcctatgggcttcttgcttaatcttttggagtttccatttctccatctgtaaagtgaggataacaaaatacttcatgtagttgtgaaaactgaaattagatgtttaaaacacttaatacaacatctgacataataaagcatgttccatagatgtttgctattattaatattacacattggccaattaatcacaacatttacgaatgaggtagatattatttctttttcccaaagatatggtgagattttctgggcagataagaggttcctttcatgatttctcataatatatgaagttagaaggagtttcaagatatgcgaaaacatgctgagacagcatggactagtcaaaaaaatctatgacatctggaactgccattttggaaacatgagctgttgtttagagtaaagataatatttggaaatatacctatcatattgtaagcacttgctaaatgaaagtttttactagcattttgtggcaaaatgagaagatatataactgagaccagtaagttaagccataatcctaaaaaaaaatctgtcatttagtaaatggttcacatttggagaaggttagtagggagttaaaatgtttgaataatttgccattatagttacatttttaccatattattagacttcagtgttttgttttctgaaatctttcctcaaagttgtaggctttatataatcttaaacatgtttcttctttatttttaagcccagtgtatctcaaggagaacttaatttgtatgtttctgattcttttatagttaactaattcaaaagttattttgtaagaattctttgatgtccagaaagccttatcattttcttataatatattcaaggtttttttcctttggaaaatggaaatcatgtcttgcttaaagtaaataaactcaaacacccaattttggaggactgtatcaaatcatattctctctctctcaatttctggtagtatcttggcttacagaaatgaccattcttgttcaggaaagaattggatagtttagcctttttcaagttagttcaattcagtaaacattttttgttacctctgatgtatggagaaatatgcacgtttccatgggtgatagcaataaaaacgatacagaaaaataatatacagtgcatatcctcaaggagtttatattctagaggtagagatagatacatattaaagaaattataatatttgactgaataaaatatccaaaagaggtaaaagcaaaattttatctgaatagtgcaagaagaattatgaattcaatttgaggaactaaggaaggattttcataaaatatatggaattcaagacagccttattagaatttcaaggattattagaatttcagtgagtgaagtagttggaggagggtgtcgctctctcaacaaaaccacttgggcataacatagtaacttcataactctattgcttgtgaagccacaagttacagtactttgaatgccaagctaagagttcatgttttattttctaagtaatagaggagccatttgaatgtccttgaggagaacacgtaatgcaaatgcaatttgggctttagaaagattatgctgatggaactgtgaaggatgaataagagaggaggaaatcaaaaggtttggaaaccaaggctgtgactacttcagttcagtcaagggttaatgaagaaataaactatggtaggagaaaagttacaaaacaaagaaaggtagccaattatgatttctggatttttacttaagatgaatgttagttagaatatagactgagctggctataacaaggagacctaaaactagagcaagtcaaacaagagataattttatttttttcttatataatagaccagaggtaggggcatggccagggtggagaaattactctgcctcataagatcatgcatggtgctgttgaaagaggaaaattgtctctcaaccactctcattctggtctttagaaaggggaatgaggaagtcaaaagcaagaaacttccttttagaaaagtgaccctagaattgtatgcactgcatgcattcacattccattcattgtaagactccaagagaatttttgattcagagtctaaaacttgcttgttcagagcccagaggttttttctcaacattttgtacttacactgtgagtggtatttgaaattaatttgggtaatatagagaagtaggttatagaaagtgggttatagatcccatgaatgcgaggataagtaggagccaaatgaatgggaggaggagagaagacccaagtgaggctgtttctttaccttggcttgaagccagtagactggccttgacatggaggctctggaactgaacgtcttgccacagatttgccagtgatggactgtaccagcagaagcaggagtccacatgaatcctacacaagcaccagactcatttattacacttatcgaccctggtttttaaaattatgtaagtattagtttaatgcctgttacctaaatatcttaagctctatgaggccagggacttggtcttttttgttcaacattgaattcacttcatatatcaaagtgcctgatatatattaggagctagataaacacaggtattttaaatttatgttttaaaaactttcaaacctagggaaaatctgaaacagtagtacaataattatacatgtttgctaaaacttttgctatatttgtatttgcatatttttctttttctcttttcatcctgaatctactgagagtaagttgcaaatgttatgacacttcctaaataattcagaaaagaaggaaggaagaaacaaacaaagacacacctgtctgttatccttttaatttctttacttttcaatttaccatgtctttgtgtttaattatcattccaaggataacttaagtaaaattacttgggaaagttttgtttcatagatacttctaacaagataaactgaagtcatttacatgaatgttatttctgaatattctacgaaaatagatttcatttcataatcacttaagaagctatcataaatcaaaagtcttaaaattaaattttataaatgtttaaatgatgcatttttcccaaagagtaattattagctaaataaaaagagaaagtgcatgccaaaacgtgaatagagtaaaattgtaataaagcagcttttattcacttgagttttagaaatattcttcattggctatttttgttttactttgagaagtgtgattttaaaattgagatacttgtaaatagaggtaagaaaatcattttcagaaggttcagcatatcctagaggatttctttcttctagggataagttatcgacatttcgatgacattcatagaccgccctagaagttaaacatcaataaactcaagacaattctataattagactttaagaagttggaagcgggatttaaaccaagcaaacaagagacttgacaaagcacaaaactgatgttaggaaaacctatagttggtattgccaaaacacaagaacactgtcattcataaaggacctactaacttcccagagacccagatctagtaaaagggcagagtagatataaaagcttatgtttgactacaaacaaataccttttctctagtttaatatacagcctcccaaacaccgaggagaatacttaaataagagaacgggaaatcctctgttgagaaatctcatatattctgtccagaaaataaatggagacattatatcgtgtataaatattcaatatcagaatgttggccaacagatttgttcatagaatagtacagtgtatatttgttttattcccatacgaggcttaaaagttccacacattacttacagataaataaattacatatatattttagctttctagttattctattttacattcacagtaaccttgcaaaggaagtagtgaaacttttagcattcccatttcaaggcaaggtaactaagggacatcaaaattaaatgatttatccagtgtcattcagtttgtcagcactgctgaattataggtagccatgtcccctgcacactctctgtgttaaggattttactgtctagggattctgaatgttcaagatcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatctaggatgaccctttttagcatttgagcggtctctttaaaaatcaaacgaaatatatggtcctcgttctcataaaataaaacaaaaacaaagcaaaactgaaaagaccaagaaacaaaaaggtaaaacagatacacatgggattgttcattacctgtaggttaagaaaccctggtctgggaatatgagattgaatcagtgtaccagctttggaacatagtaagaactgaaagactaatagatgacagaatgttacagacgaattcacaatgagccatgaaggaataggagaccaatggcaaggatatagaagaacctgggcctgaaatatgctagtccttcagtagcatgacttagataaggatctgtatccctggactccccaatttttggggagactatacctggactattttatttgcctgaacatcttaaataaaaattcaagggaaaagcagtaaaagtacataacacaatagagaaataaatgaagaaaaattaaaagtactttagattttcccaacatgaataaagaaaactgtctgtagagatatctaaattataaagagaagaaagacatatttttttatcatggttaatggagttataactagaaacagagaaagctatatatgtgtatttatttttataggaatgaacatatgtactctctcacaaacaaacacgtgtgtgtgcatatgtgtgtatgtaagagatataccatttatctatcttcctagctctctatataattcctttgacaatatcattactagtagattcaggtactatctctcaagggatgtagtataaaacatagctttctctgtagaatgaaaaaaatagactagatatgtgtgagcagattggtgtatgcaatttccaagtaaactccaaggcagtgaaatacgaaagtttaaaaaaaccaagtttccaaaaatatcatagaatttctgaaatatgtatatatcatagagtatatttctatgtaatcaattagtataaacatgccaaaaatattagctattaattaaattggagctataaaataagactattcattgagagttttacatggtatctctgtaaacatgattaaagttctaacccattgtgagatgaggaataggctgcctagcaactgttttaactagttcccctgagattctcaagcaaaaaatgggtgtatggatgggagtatttatttttgtttctatattaaagcttctagatgattcctaactagtcactctcattgtttttcttcttttcatcatctgaaagtaataatttttaaaaatagtaaagaaaagaaagaaggaaggaaggaaggaggaagggaatgaaggaaggaaggaagaaaagaaagatatataaggatcaacatgagtcatctcaagcaatcactgaagaatccaaatataataatgcaaatcaaagtcagatgcttctgtttatcaaatacaggcatatacagctttttgtgtaatgctcacaaatcaaattcaaagtaatgatactggcttaataaactacaggttcattgaaatgaatggcaggaaaggtagcatttcttgattcaggatgtaagggcaactttaaaactctatagctacttcatgaaaccatacattgctaagaagatgttctcataaagaaaacatggcagattaggtcattctcctccttcctgacttcctggttaggtaaaatcacactcataaaacactcccagcacatattcataggatgtcctagcatgttctaccaggagaggggagagaaagtgtttggtggtgattcaagcaacagtaagctatgtagagggttttgagtgtttccttagagagagagagagagagagagagagagagagagagagagagagagagagagagagagagagagagagggagacttcgtttttactacatagctatcataaagcccttatgagtttgagagagaagaattaagaacggatctcaggttaaattccagagttaatgatgtgttaatgaagatgtaggaagcaaaaatgattagtttaaaaggtgagaatctcaagcaaaacaaaagaggtggtaggtctggagtatcaccgataagttacataaataagatgtttattaacatacattacctatttatgcaattatttttgtagcttttgactccattctaagactatattgctaatagggtttagtaaacatagttttgcaaacctacattataaagatgtttcaacctcatacattggcctttaccatcacgttgaatacagaaatactgttctctctggaatttattgtgagtcctgggttcatttacattttatcagtgacccaacatgaaacataacatttactttttgtttagtactttcctgaagcagacaggagaaagtcattgaaattgcttcaaattacctgagaaattgccataatttgcaacttcacaatgcaagcctggatttcccaagttagctctgatctcaatgatgagtttaaatgccaggatgatattttaactatgcagagtcataggcatacatgaaactccattagtttagaatctaatgaagacttatgttgacatatcattctatgtatttcagcatattatctactaagacattataagaacaaaaccccccaaaattccattcttttttgaggtagggtggctttttctcttttaatatttttttacatttgagttcttcatgtttcctgaaggtaaatgatgcatgagaaaacttggaatatcttgactagcattttaaaagcatattaaatattattttcaaaactgaactatgaatagttctgcacaacaattttcttgttggaaattctgatatttatccatttttcctttgatgacctagcatactaatgctatacagactacttcaatcttccccaaagttgtgaaactcacaatttcatgaaagatcaaggatacagatactctttgaaggggtgatttatatgtttagtggaagatggttattttttacaaggactttggattcttgtgaatgtaggttttacaactaagaatatgttagatgttattttttataaatttcatgatagtcctaaatttcattaatgtacaaataaaatgattccatggttaatacagtcccagaactaccagagaccatgttatttaattgctataaatcttccaaaaacaacaacagcaagaaaaaagttaaaattcctacctaacgtggtgtgttatttaaaagggtaccatattcattgctttattcatcctagttttctgcaagaattgagaaaaatctttacatagttgaaggttttataatgaggaaaaaaatcagtagcttgcaaggaagctaaaataggttcaatgttgctaaactgatacaagttgtactctaaaaatgcaacaatcattgagaatatctaggacaaccttctttccccttttttttattttagggtagatcctctgttatggtctcactgctaggaacttcttcacattatttcatagaaatcttgtgtagagcatagaaagagttgtgacagggttgttttgaaatatgtgcttactggagccaaactgctaaatttaccagccatctgacatgagaaaaatcatttgatttttgtgtgccttagtttcctcatctttcaatgcagataataatacccattgcaaagattgcagtgagtattaatatacataaagaactacggtgtctgtccacaaaatatcacatggattgtgacatggcattataacaagcataatgttgtgttggcaaaatactgtatcagttttataatttagtgctttgaggtccaccaaatgtagtttttaatttattgaacaagcatatttgagctctgaaatagttaagatcaactccctaaaattattggtgctacttaggaggccagaggtataaattgttactgttgtcaatgttccacacaaatcacttaggatatgtgaatgtctgctggacagaattcgacttcttttgtggggaactatcttttgtagggaaatgggctcatctttgaagacactgtacaaccaaaatcaaatcatagcaagagacccactttattaatttgtccaatttgattactaagaatttaaccagtattagcttctttaaacatgcaatatgaaataatattttaattgcctggtataagcaatacaccaattaggagatttgctgaatgtcctagcatttgtgcatctttataaacacttcatggatagttccaataagaatccattccatgctgactgctgtgctagggctactcacccagagacgtgataggggctactcccctaagaccaattcctcctggcaggccactcacaatctcacagcaggaggcagctaaacacaaaatcaatattaatataaaatcaactgctatatttttaaagagtagtgtttggattacataagcaatcataaaactcccgttggctttagcaagaggtttagtcctgtaaactccaaaggttttctgtgtgtgctgagcagacaagcatcctaacagaataagccagaactttcctagccatcctagcatgtttgtgccttgtaagatattcccagttacatcctttaatttgccaaagggcagaaaaagaatttggtaagttaactttcccacatgcacaaatttaactgctgttttggtattccacacaggggccagattggatggaagggcaagagggctgctgagggagatcactgcaagtgaaggcaaaatctagtctgatggctcagactaaaaaacttggcctgccaataagagggagcagtgcttccagtgaaaatgtgaggcagtgcctggctttccctgctatactccaccctcctccactccctggactgcctgccaagaaagagaagggtgagcaatagagaaggaagtgaatcactagcacttcacaagtgctgctgcagaggcctgccatagagagctggctgagacctaggtgctctcctgctgatctgagagggcagaaaaataaataaatagaaatgtcaaaaagaggacagcagcagtgtagggaagggaggcagagaggaacaaccccgggcaggaggagtgtgggtcaaatgtgagaaccaataccctccttccctagctaaagttgttcccccatcagcctcagtttccaccatctctgaggcattcacaggaggaataactggtgtgttaaaatccaccaaccacttatatacaggaaagaaaaaaaaaaagatagggtctttaatcttgttgcagtaaaggaaacacaatggaagataagcgtagagcctctcggtgagaggagtggcaggttttaacagagtttctgcttgtgctgaattattgaagaagggcttagggatgtggaagccgatctggatacactgtcaagaagagggggcagtttagttaccggacatttcagtaatctttgttcaggaggccagatcagctaggcaagaaagcagcagtaactcagaagtagcttcagtgtgatcttggccacatcctgttagaaatacactttgtttctgttggccttgtcagtgtcctgttggaaacatggttaatgtcttggcatcaacatcagaattctattactaacagtgctgctttccgtggtctcaagtaggagatccttaggacaaaactccaaggagaaaaggagcagcaggcatcagaattttgatattttgtttattttataaatatggcacatgagtttggctggtgaggccaataaaatacagattttgtgtgtgtgtgtcactagtgtgaaaaaagttgtagtggagagcttggtatgtcaggcaatggtgctaggagaggctgtcttttgggaaatatttcataaaatgggaaacacttggaagaattggtagtttgataaactccataaaagtgagttgagtgttggccataggtgagaacagcatggaaggagtggagggagtggagagaaaagaatgtgtcccaggagaaataaagggctgcaatatttcaatgtacagagacctgagtatgtttgggtttaggagacactgagttacacagaggaataaaatatatggtcgaaggtaaaaagcggcttgggtgaggctggagacagaatcttaaatggagttaatacattattctatatgttcttctgaaggatcaaaaaatattattctctaactttccccaaaatagtaagcatcataaaagtacttttctaagacagttgatccgtatgcaattagcaaagtaaaacagactggaagaaataaaaatattacaaaattggtaaactgttattctgtgtttacataagacaagcttcctaaaacactgcaaagtgtatcattttattatctacacagagcagagaaagcaaaggcaaaatgttaattatgttttatgcttgctgctggattctattacgtatttatgatttttaaaattgtaaatacaatgcaagtacatattgctattatcttcagtttacaaatgaagaaattgagggccatttggtataagtggtttgcatgggatcacaacaatgaagtgccacggcagtgattgcaacccaggtttctctatttctgatgctatactatatgtgttccagtaatccatttcatcctatcttttgtgtccacttagttactatctactacaaattctacttttaaatactatttatttcctcaaaacagaaaaaaacatgaaaatttgtttatcctatctcttcttccaaccactacgtcattcttctattaacttttcttttaaagaaaagtctccaaagagttgctctttccacttcttcaccttccagtctcgtttttttttttcaatcagctttattgcagcataattgacatataatatatacacatcattgttaagttttgatctgtgcatgcacccacttaaccgttactacagttatgaaccaaactcacccatgaaaatttcctcatggttccttgttattcctacttcctttcattattatggattgtagttttctgtattttggcatttatggtaattttgtggagaatgcaaaatttgtgtgaatattactttgttggtgctggttttttttttatttctataaatattcttgagcttcctcttgagatatagttaagttatatgagtcttattataaactttgttgcatgagaagatagtagcatttcatttaggactaagttcacccctctgtttaaacataaaccttctgagcaatctacctgatgtcctgtgaatcatgatgttttccattctggctgttgagaacaacactattcctatccctttgtgagcactgaagacttttccctcataccctttcaggtggttcttttcccaaactcaagtagttttctcacatgcactgagcagtactcagctgtatgtacaagggggactctggagatttctggggttatttctttgtatagctctctctacttcagtactgtgctgtatacatgccagccaccttgatctccctgcaattccagctcctcaactcaaagttctgtgttccacttgtgttcccattctgtggtataagaataaatgcatatttactgtttgttccatttctggtacaaagcagagcctaaaagccttgtaatttcctgagtgataggagtgtcttttgttaataataacaaacttctttcaaccacatttgaatttatgctaatgaggtgaccctcttatggccgtgagatagcttcagggtgggggttggttgtcagaagaaccagccttctcattagaaggttggaactttcagtcccttaacctccagggagagaagaggggttggagattgatttcactcacaagtgaccactgatttaacaaatcatgcctatgtgatggagtctccataaaaaaccctaacccatggggtttgagagcttccaggttggtgaacacattgaaatgctggaagggtggtgcaactggagaggtcacggaagctctgcaccctttcatccatactttgacctttgcgtctcttccatttggctgttcctgagctttataataaactggcaatagtaacattaaaataattaatcgggagaccaataggctgagacaactagcaccttgggttcttacagaagcaaacaaaaacccaactcagtgtcaacagtaacatgaaacttaagcttagctaatcagctactgccagtcaacctctaaggacttccactttaactagtcaaatattttctttgtcatgtttccatgcatcccctataaaagtgtttgcctcatgcccccttaatggagcactaactgcttgttttctggtgctggccaatccatatattgctgcatgctcaaataaattcattaagattttaatttgcctaattttatcttttaatagtctgtaaagctgtttccagtgtctgtaaattgctacagcaaattcttaaccatggggggatgtcctgggaaccccttactttgtagttggccaagcataaaggtaggtagtctaggcaccccattagcaactggagtctgaagtgtggtcagtcttgtgggactgaagctttcaaacctatagagtctcatgcaaactctcggtagttagtgtcataatggaatttaattgtaggacctctggttggtgtaaaaaatcagagaattggaaaattggttgttggtgttagaaaacacccaggtcttccttgtgctatgacctggaagctttctccaggcagtaaatagagcaatcaaaaggctcatgctttttgtcaatggatcattgtctttcattttttaatggtcaatgtattgagaacttttattttaaatattttgtccacttttttagttgcttcatgtgggagagtaagtccagtctctgttactccctcttggcaggaagtgaaaatccctttatctctcgaatctgcaaccccacaactttccatccgcagtcatcatagatgctcctactgttttgttcacgtgtgatcttcaaaggtcaattctcaatcctcgtcttattttatctactactgtcaattcccacatagttacttatttctctcctcccttgctgacttaggttttctagggtggccttcttaaagtgccacaaatggggagtttacaataaacagaaatttattttctccctgttctggagaattgaagtccaaaatcaacatgttgacaggactatgctcccctctgaaactcataaaggaagaattctttcttgtctcttcctggcttctggtggtttgccagcaatctttgtcattcctctacttgtagcagcagcacttcaatctctgcctccaatatcatgtcattctcacctcatgcatccatgtcttcacatgacattctcttctgtgtgtttctatcccttcttcttataaggtcaccagtcatattggatccctattctaatgatctcctttgaatttgattacatttaaaagatcttatttctaaagaagatcacatgcacaggtactgaagcttcagatttcaacatatattttgggaggacaacattcagcctgtaacactgattattctattataccttcttctgaacttctgaaagttgaagcatcctagctgagtcttcagacttcttcttttgcatactccctcagtaataatcttatcgggtcctaagtctttaaacatcacctcaacattaaagtttccaaacattatattattgatgccaatttgtttcctgaattccaaattcatatgttcaactgcaaaatctatatttctaactaaagaaatccaaaacaaagccttttttctgattcctgccgaccctcccatcaaacatgtccttctattctttctcatcttaggaaatgaaaatactatttctcactgttgctcacattaaaaatttgaataactttaaactttgttaaaacccagtaaatctgaaatttagcatcctaaatttaccatctagcatcgtctgatatccttgcccagtcatcattgttttttgtttctaatttaactttagcccttgcaatagttctctaattggtcttcctgtttacattattacacattgtattccatcatctgcaaactaaccacagtagtcattttcatgttcaaaacttttattggcttctcattacacatagaacaaagttcatatttttaaactctaaacaatattgttctatgtaatctagcattgcatcctcctcctcaatctcacttccttcccttcttcctgttgctcactccactagctttctagcttctgtttgaataagtcaagcactttcctacctcaagggctttgcaatagttcctttctgccgggcacagttttctcaaccttctcatgaatttctttccacaaatattctttttttttttttttttttgatggagtcttgctctgtcaccacccaggctggagtgtagtggtgtgatctcagctcactgcaacctccacctcctggattcaagcgattctcctgcctcagcctcccaagtagctgagactacaggcatgtgccaccaaaccaagctaatttttgtaactttagtaaagacagggttttaccatgttggccaggatggtcttgatctcttgaccctgtgatctgcccgtctaggcctcccaaagtgctgggattacaggggtgaaccactgcgcctggctctcttcccataaatattctatagttcaatctctcttttattcaaatctgtgtccccaaaatcacttccagagatgacttaaaccactgtgtgtcctgaccactgtgacttaaacatcacacccaggatttctccagttctctctgctttatttctccttataattctaatcctttattgacattattttagagattttagagatatatgtatttgtttgcatgatttcccctttcctccatcagactgcagccctatgaggatcaggatttttgtctgtttttagtatatttaaaaaattcctgcttaatacataggagttattcaaaatatttctgaaaatggagtaatttttatttattgatacatacctagtatttatcagaatgcctggcataatataggtttcagtaggtatttgctcaatgaatgaagagtttcttaatgtaaactgaataaacagaaacaaattattaggaaatgtaatttagatttaaaaggcctctgttgtttacaaatgaattctaatcaggtaggtactagcagctcctcagggaggtaaaagctatcatttagaatgtggctgccctttctgggtagctttttgttttttctgatcataatggcatgcaaaaagataatacaagaaagtaccaatgctaaggcttacattggtaaagagagagagaatattactcttcagcaattgttcattgttatcagtactggatttgattacggatataggatttatagctctaaatttggagctctaaagaaacctttagttttgaaataactgtaagaatttgtaactcttgagtttccaatattaaatcattttcccaacttttaaaagttagattctccttttatccataaaatggtcctgaatacttgaagtttattataatcacatatctcatgttaaaacaaaaaaaaagctacaatccctgaactaacaattttctttttggggattctgggcaagagggctgactagaagcagctaatatgcaccaatttcaaggagagaagacagtgtgatcagtaaacactagctcttcaactagatcatccaagagtaaacttcggaattcatgaagaaaacaacacaacccacagagaatggagaagcgtgagatatgacaattgcccacccggagtggtacagagccaggggaggcccccacttcgggaaaatggtcagtgagtgagggtccctggggaccacacttctgccatggacccctttgcaatcctgggcacaggaaataccctaggacccctccacccatgggagagaccaccttgactgtggactaatgaagacccccagcatagcagagctgccttacagaaaagtggccacactgttttccatgagggtccccacccctgctactcctcacagggcaaggcctcctgacctaggatctcagaaacacccaacctgggctttcggcctgttgcagctctgcgttttcttggaacagagctcccaggggtaacaggcaggcctgcaaattttgcagctccacagtcctcattcctgctgctctcaggattgggagggtagtgcagggattagggactatcatgggcccccagcacagcacagctgccttaccaacaaacagtcagatggttttctgcatgggtccctggccctgctactcctcactgggcagggggctttttgaggtgtgcctgcagcataactacactgcccgcacctgaatacttcagtcagtggcagctctgcgtttctctgaagaaaaaaatcacagagacatccacagcccctctgtcattgcagctgcagtagtactgcccttactgccttcaggctggggaaggaacaaagggcctggttgatatgccggcacctccagcatgccacagccaccctatgaaaaggagctcagtctttcttccctgtgagtcctcacccccaactcttcaccaggcagggcccctggctcgggaccacagaacagctgccccaccccaggctaagcattcttactggtagttgctctgggtttcccagggatggagctctcagaagaaaccaacagcttctccgctatggctcctgcagtggttctgcccttgctgccccaggactgggaaaggagcaaagagtttgagggctttactcacatttccagcatgccacagtcaccatacagataggagtatagtcaccccttcctgtgagccttgacccccagcttttcaccaagcagggtccctggatgaatattcagccacacccagctgaacattcccgttagcaggatccttgtatttctttgaggtgaagctccaagaggcaactgaaaactcctctgccactgtaactgcagtggtacttcctttgctgccttcagactgggaaaggaacaaagaccatgagtgctttaaccacacctccaataaaccatggctgccctaaagagaagaggccagtctgtctccccaggtcccctggtccccgctgcttgtcattgggcagggactcctggcttgaatccacaacacagctgccccacccagggctgattgtaccaactggtagtggctctgcatatctctgcagtggagccccaagaaacaagtgaaagtcctgctgccacaaccattgccaaggtcccatctcttgcttcctccaagctggggagggaacataaagcctgagcttaccccagggctgcagtgtggatcctgggcatgccaagctaagatctacagccagcattctggaggagctgacactttcagatcactaagagggagcacagatacaattgggaggaagtacagaggttccacatggctgagcaagagcctacctactggccattatgcttcagcaccatctactgagtcatagcccaaacttcatcaccaaaaacattttgctaatatacccacctgtgaaaccaaggacaaaaattagaattcagctacaaataaagaccctgcacaaaggtcttggccttctgaaaacatccagaaaagaagtcaactgacgatattcaaattataccacagttaaaggaatatcagcctacacaaatgagaaaggacctgacccgtagaagaactctggcaattcaaaaagccagagtttctcctttcctccaattgattgtgctggttccatagcaaaggttcttaaccagactgaaagtactgaaatgacagacatagaattcagatatggatagaaatgaaaagcatcaagattcaggagaaagtcaaaattttattctaatccaaggaatctaaggattgcagcaaaacaatacaggagctgaaagatgaaatggccattataaggaagaaccaaatggatctgatagaactgaaaaaacacactacaaaaacttcataataaaatcacaattattgtattagtttgttcttacactgctacagagaactgcctatgactgggtatattataatgcaaagaggtttaattgcctcagagttccacagggctggcaaggtctcaggaaagttataattatggttgaaggagaagtaaacatgtccttcttcacacggtagcaggaagtagaatgagaactgagtgaagggggaagctccttataaaaccatcagatgttatgagaacttaccactgtcacgggaacagcatggggaaaacttcccccatgattcagttgcctcccaccaggtccctcccaccagacatgggattatgggaactataattcaagatgaggtttgggtgggaacccagccaatccatatcattccaccacacccaaatctcatgtcctcacatttcatgcctttccaacagtctccaaaagtcttagctcattccagcattaacctgaaagttgaagtccaaagtctcatctgagacaagggcaagtcttttccacctaaaagcctgcaaaatcaaaagcaagttagttacttcctagatacagtggaggttcagccattgggtaaatacacctgttccaaatgggaaaaagtggccaaaacaaaggggctacaggtctcatgcaagtctgaaatccaacaaggcagttattaaatcttaaagacccaaaataatctcctttgatttcatgcctcacattcaggtcatgctgatgcaagaggtgggctcccatagtcttggggtccaaatctcaattcttgacttctgtgtaccagaaggctcaacaacaagtagaagctgccaaagcttggggcttgcaccctctaaagccatggcccaagctataccttggccccttttagccatggctgcagcagctggaatgcagggcaccaagttgctaggctgcacacagcggggggaccctgggcccgtaaagccatttttttcctcctagacttctggatctgtcatgggaggggctgccacaaaggtctctgacatgccctggagatattttccacattatcttggtgattaatatttctctcctcattacttgtgtaaatttctgcaaccagcttgaatttctccccagaaaatggtttttctttcctatttagttattgggctgcaaattttccaaacttttatgccctgctccctcttgaacattttgccacttagaaatttcttctgctagataccttaagtcatctctctcaagttcaaagttccaaagatctctggggaaggggcaaaatgccaccagtctctttattaaatcatgacaagagtcacctttgctccagttcccaacaagttcctcatctctatctgagaccacctcagcctgaactttattgtccctatcactatcagcattttggtcaaagccattcagcaagtctctaggaaactccacactttcccacattttcctgttttcttccaagccctccacagtgttccaacctctgccggttacccatttccaaagtcacttccacattttcgggtatccttatagcagcaccccactctaccagtaccaatttactgtattagtccattctcatgctgctataaagaactgctcaagactgggtaaattataaaggaaggaggtttaattgaccacagttcctcagggttcgcaaggcctcaggaaacctacaattatggtggaaggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttcccactaggtcactcccaccatacatggagattataggaactacaatttaggatgagatttgggtgggaacacagccaaaccatatcaagtattaacagcagaattaaccaagctgaggaaagactctcagagctcaaagactggttctccaaaatacagttagacaaaaataaagaaaaaattaaaaaatgaacaaaacattcaagagatatgaggttatataaagagaacacattttcaactcattggcatccctgaaagagaggggagaaagcaggcaacttggaaatcatatttcagaatatcattcaccaaaactttttcagcttcacaagagaagccgacattcaaattcaagagatgcaaataacccctgcaagatactatatcagatgaccatcccaaagactcataattttcagattcttcaaggttgacatgaaagaaaatatattaaaggcagctagaaagaaaggacaggtcacctacaaagggaaactcatcagattaacagtgactgtttcagcagaaacactccaatctgaaatagattgggggcctatattctgcatttttaaagaaaagaaactccaaccaataatttcctacccagccaaactaagctttataagcaaaggagaaataagacccttttcagacaaggaaatattaagggaacctgttacaaccagacctgccttacaaaacgtacttgagggagttctaaacatggaaagcaaagaccattaccagccaccacaaaaacaaacttaagtacataggttatggacactataaaacaaccacataataaagtctgcataataaccagctaacaacacaaagataggatccaattcccttcccccacccccccgtgaatattaaccttgaaagtaatgggctatgtgccccagtcaaaaggcacagattggcaagttagataaagaagctagactgcaagactcaaatgtatgctgtcttcaagaaacccatcccacaaatagtgacacccatagactcaaagtaaagggatgaagaaaaatctaccaagcaaacacaaaacagaaaaaagcagggactcctattcttatttccaacaaaacagactttaaaccagtgatcatcaaaacagacacagaagggcattgcataataataaagagttcaattcaatgagaagacctaactattgtaaatatatacccacccaatgtaggagtacccagatgcataaagcaagttctgaaacacctacaaaaagatgtagataaccacacaataatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattggccacaaaacaaccctcagcaaatcaaaaaaaactgaaatcataccaaacatactcttagactacagtgcaataaacaatcaacactaagaaaattgcttacaactatgcaattacttggaattaaacaacctgctcctgaatgacttttgggtgaaccatgaaattaaggcaaacatcaagtaattctttgaaactaaactctagtatcccagagataccagaatctctgggacacagctaaagcagtggtaagagggaattttatagtgatgcccacatcaaaaagttaaaaggatctctaattcataacctaaggtcacacctggaaaaattagaaaaacaagagcaaaccaacgccaaagctagcagaagacaagaaataaccaaaatcagagctgaactgaaggaaattgagagatgaagagcaaaaaagataaatccaaattttaatttttttaaagaataaaaagattgataaactcttagctagactaataaagaaaaaaatagggaggacccaaatagacgcaattagaaaagacaacgaagacattaccactgaccccacaaaaatacaaaataccctcagagacaactacaaatacctatgcacacaaagtagaaaacttagaagaaatggataaattcctagaaacataagctcccaaggttgaacaaggaagaaactgaatccctaaacagatcaataatgagttccaaaattgaatcagttatgaaaagcctatcaattagaaaaatacaaggaccagatggatccacagcctaattctaccaaatgtataaagtagagctagtaccacttctactaaaactactccaaaaagttgaggaggagggactctccctaacgcattgtatgaggccagcatcatcctaatactaaaatctggctgagatgcaacaaaaaaagaaaatgttgggccaatatccctgatgaacatagatgctaaaatcctcaacaaaaatactagcaaatcaaatccagcagaacatcaaaaagctaatccacagcaatcaggtaggctttattcctgggatgcaagattagttcaacgtatacaaaaccaataaatatgattcatctcctaaacagaactaaaataaaccacatgaacatctcaacagatgcagaaatggctttcaataaaattcagcatcctttcatgttaaaaatcctcaacaagcaaggcattgaagaaacatacatcaaaataacaagagccatctatgacaaacccacagccaacatcatactgaatgggcaaatgctggaagcattgcccttgagaaacagaacaagacaagggtgaccactctcagcactcctattcaacatagtactggacatcctagccagaacagtcaggcaagagaaagaaataaaaggtacccaaacaggaaaagaggaagtcacactatctctatctgcaatctgtttctatacctagaaaaccccatagtttctgcctagcagctcctagatccaataaaaaacttcatcaaagtttgaagatacaaaatcagtgtacaaaaattagtagcatttctatacaccaataacgttcaagctaagatccaaatcaagaacacaatcctattcacaatagccaaaaaaggaataaaatacctaggaatacagttaatgacagaggtgaaacataaacatctctacaagaactacaaaacgttgctcaaaagaaatcagagatgacacaaacaaatgtaaaaacattccatgctcatgaataggaagaatcaaaattgttaaaatggccatagtacccacagcaatttagattgaatgctattcctcttaaaacaccaattacattcttcacagaattataaaaaactgtttcaaaattcatatggaaacataaaagagctcaaatatccaaggtgatcctaagcaaaaatagaaaagctggaggcatcacattacctgacttcaaaccataccacaaggccacagtaatcaaaacagcatggtactggtacaaaaacagacacatacaccaactgaacagaatagagagcccagaaataatgccagacagctacaaccacccaatttttgacaaagttaacaaaaaacaagcgatgggagcaggactccctattccataaatggtgctgggataacctgctagatatatgcagaagactgaaactaaacccctccctgacaccatatacaaaaatcaattcaagatggattaaagacctaaatgtaaaacctaaaactaaagaccttagaaggtaacctacaaattaccattctggacataggtcctgggaaaattttcttcccaaagatgccaacagcaatggcaacaaaaacaaaaattgacaaacgggacccaattaaagtaaagagcttccgcacagcaaaagaaactatcaacagagtaaacagacaacttccacaaggggagaaaatatttgcaaattatgatttgatgaagataggttcttcatagattctaatatccagaatctataaggaacttaaattaacaagcaaaaaacaaccccattgaaaagtgggctaaaaacctgaacagacacttttcaaaagaagacatacatgtggccaataagcatatggaaacaagctcaacatcactaataattagagaaatcaaaaccacaatgagataccatctcatgccagtcagaatagctattattaaaaaggcaaaaaacagcagatgctagtggagttgcagagaatggggaatgcttatacactgctggtgggaatgtaaattagttcagccactgaggaacacagtgtgatgacttctcaaataacttaaaacagaattaccatttgacccagcaatcccattattgtgtatatacccaaaggaatataaatcattctgtcataaagacacatgaatgcaaatgttcatcacacactattttcataatagcaaatattgcatgttctcactcacaaatgaaagctaaacaatgacactacatgggtacaaagaggggaacaacagataccagggactactaggctgaaggataggggagggagaggattgaaaagctacctaatagggcctgtgcttatttcctgagtgatgaaataatctgtacaacaaaaccctgtgacatgcaatttacctatatagcaaacctacacatgtatccctgaacctaaaatataacttaaaaataaatattttcttttcattttttgtattaccagtttagttttcttttttacctctcactcagactgttgcaataatctccaagctgtattttgtgcatttcattttcccccatcctatttattctccacattgcttcctagatcttttttttttttttttcttttttttttttgagatggagtcttgctgtcacccaggctggagtgcagtggcgcgatcttggctcactgcaagctccgcctcttgggttcatgccattctcctgcctcagcctctcccaggactacaggcgcctgccgccaagcctggctaatttttttgtatttttagtagagacggggtttcaccgtgttaaccaagattgtctcgatctcctgacctcgtgatccacccgccttggcctcctaaagtgctgggattacaggcgtgagccaccgcgcccagccctagattttctttcctaaaggaaagatgtcaagccactttcttgcttgacaatatttagcagctggcttgccattgattttaagataagctccaaattctccattgtattagctagctatggttatataacaatattgtaacaaatttattgtcttattttttatgatgtcagtatttatgatgtcagtttctgtggctcaggagtccagggatggtttggctgtctactctgattcagagtttcacaaggtttacagtcaaggtataggctggtgctgctgtttcaagctctgaagtttaaccggggaaaaatccatttccaagctcatgtggctgttagtatctttcagctcctgtgagctgttggccagaagctgttctgagttcctggctggctgttgacctaagactgcctcaattccttgttccatgaatcttcccaatgtggacgcttactttgtcaaagccagcaagggaaagagtctccttataagatggagtttacaatcttaggcaatgcaatcacatcacctttgccacattctgtgggttagaacaagccccagactctgcccacactcaatggtaggggattgcatcagccatgaatatcacaaggtcatcttagagtctgtctgccacattcatcaagtcatacaatgcccttaaaatctggtctcaactatccttcttttttctactccagcactgtatattttgtcacactaaactatttttaagaaattatattgaatcacacgaacaactgtattttgttggggggatttttgttgggttttttttgcttccaagtttttctcttgttatcttctgtgcctgaattacacttctgcaccttacctggcaaaattttaccaaagaccttgtgcaaatttcagctcttcttaaaacactcctggttctacccggaaaaattaatagctccttccgaactgtgttcctaaagccctcccaccgccttcctatccattgatttcattatggcataatttggggtgcttgcctaaaattgtaattccagtaagagtagacagtgttttatcaatactgaaccctcaacacctagcacaagatcttgtactcgcaaggacttgtacatttgctaatgaagtgaacaaatattgcattaatttcaaatgtttgctgaactgaatttttgaatgctgtgttgaccaaactactagcagggcaatgtgtttcattcttgaaaagttgtacctttgcattccaaacacaaccttgcctgcttcccagagttccaaaactaaagtaaaacatccaattaatcaatcaattacgcaactgataaatcaaagctagagaagtactctaatcaagcataacttattttcctatctgagatgttttccacattttgtatttgctgaagcagtgcaaaatgttgctgcttaaagacattatgtgacaatctgttttcattcctatgctctaaaaattatgaatagtaattttaatattctttattattttttatattttaaatcagtgttattagttttcccatattaatttattttaatgacatatatgtaatttcaaggtttggaaaactttagatagcaggtcaaattctttttaattcagtctgttcaactgaggtctttatgggcttggagtagatattgctttaggctgtatattagtcaataagctagataataaaaaatggagtatatttttccattttagagtaatgatgaaagtcacataaagacaatttcccaggtaactgaaattaatattcattattgctaaaaagtttttgtttttattttcatgattgggaggaaagcatttcttaattgggttattcatattctggcctcctgaactagaagttcagataatttgaatttctgaaataattatcagtcataacactgtggtgtgatataaccatgcctttaaagcctgttacagggaatctatgctacagattgtaacagctatgcttttcttatttataactgctttttaacttacttttaaaaatgtagtttctttctatcaatgtgcctgcttccagtgctgcctcctccaccaactcttcttaggcatttcgaaacatataaccattgagggtatatatgatcctgacattaaaataaatttattacaattttattattattacttagtagtattgaacatttactgagctcttcctatttgccaaacactgttctaagtccattaggtgtataatctcatttgtcttcacaaagactatgggttaaggtaaatggtagaagagcaataatctcctagacagattaaatactttatgcaaaggaagccctgtggtaaagagagagttagtatgaataaacatggaaacaagtccaaaaaagctggagtaagaagtgtcttggtggaaatggataaaagtgggaattaaaaggtgtgcaggggccagatcttttaaatgctctggttcaaccttacctttagaaacattctgttatacccattgagcaaaataaagcatcctttcttctttgtttcttgaaaacatgacttctactttgaatgacatttggttgtttctgtaatttatcttcattggctctattaatttaactcaaattaaaaccccatctctactaaaaatacaaaaaattagctgggcgtggtggcaggcgcctgtagtcccagctactctggaggctgaggcaggagaatggcatgaacctgggaggcggagcttgcagtgagccgagattgcgccactgtactccagcctgggtgacagagcgagactctgtctcaaaaaaaaaaaaaaaaagaaatacataaaataaattagaaggattggcaaaataagaaatatttcaccttgaggtatatttatatggatatgttattaatatactgaaaaatcgtataacatatttaaaaatctgatgtgtcttggtataaatggtatcagtcaattttggttcagaaataacattcttgtcaattatgtcgtcattaccatggactcagaccaggttttggccatggtcacttgaagtcttcatgtccacacttaattgctttagtctaatgtctttctgaaagcttcttgcaggcaattataatcccagagaattatgtcttcaaggagcttcatggaaagaatgaagtctgacaagtacgggtttctaataactttgagttcacactattgaactaaatttccaaaactcggccaggcacagtggctcaagcctgtaattccagcactctgggaggccgaggtgggcggatcacctgaggtcgggagttcgagaccagcctgaccaacatggagaaaacccgtctctactaaaaaaaaacacacacacacaaaaaaattagctgggcgtggtagcatatgcctgtaatcccagctactcaggagtctgaggcaggagaatcgcttaaacccgggaggcggaggttgcagtgagctgagattctgtcgttgcactccagcctgggcaacaagagtgaaactctgtcaaaaaaaaaaaaaaaaaaaaaaattccaaaactcgaatgaagaaactgatgggtttgtgaaattgctaatacagatcacagcaagaattaatgacaagactgaatgaactgatgaaaaataattattaatctttttttttttttttttttgagatagaacctcactctgtcgcccaggctggagtgcaatggcgtgatctcggctcactacaacctctgcctgccaggttcaagagattcctttgcctcagcctcccaagtagctgggattacaggtgcctgccaccatgcccggttctttttttttttttttttttttttttttttttttgagacagagtttcattcttgttgcccaggttggagtgcaatggcgagatcttggctcactgcaacctctgcctcccaggttcaagcaattctcctgcctcagcctccctagtagctgggattacagacatgtgccaccacgcatggctaattttatattttcagtagagacagggtttctacatgttggtcaggctggtctcgaactcccgacctcaggtgatctgcctgcctcggcctcccaaagtgctgggattacaggtgtgagccaccaaaccaggcctgaatctttttttttttttttttatggcagggtcttggctccgtcacccaggctgaagtgcagtggtgtgatcatggctcacagcagccttgaattccttagctcaatcgatcctcccacctcagcctcccaaaatgctgtgattacaggtgcaagccactagacccagctgaattatggatttttaaggctgctttatgtcaaacattgtgggttcttttaatattgttttccagatttaaggaaacttttttcttttaagctttgtataatttatagtaatttggtacttttgaaaacaaaaatgaaaacatttgcttttcctctctacctgaaccctccagaatttagaagcaatttatgattttttttttattattatactttaagttctagggtacatgtgcacaacgtgcaggtttgttacatatgtatacatgtgccatgttggtgtgctgcacccattaactcatcatttacattaggtatatctcctaatgctttccctcccccctccccccaccccacaacaggccctggtgtgtgatgttccccttcctgtgtccaagtgttctcattgttcaattcccacctgtaagtgagaacatgtggtgtttggttttttgtccttgcgatagtttgccgagaacgatggtttccagtttcatccatgtccctacaaaggacatgaactcatccttttttatggctgcatagtattccatgatgtatatgtgccacattttcttaatccagtctatcattgttggacatgtgggttggttccaagtctttgctattgtgaatagtgccgcaataaacatacgtgtgcatgtgtctttacagcagcatgatttataatcctttgggtatatacccagtaatgggatggctgggtcaaatggtaattctagttctagatccctgaggaattgccacactgacttccacaatggttgaactagtttacagtcccaccaacagtgtaaaagtgttcctcgttctccacatcctctccagcacctgttgtttcctgactttttaatgatcgccattctaactggtgtgagatggtatctcattgtggttttgatttgcatttctctgatggccagtgatgatgtgagcattttttcatgtgtctgttggctgcataacgattattcttatgtttacagcaacatggttatttgcatagattcaaaaagaatctgttctctggccaggcacagtggctcacacctgtaatcccagaactccgggaggccgaggcaggcggatcacttgagatcaggagtttgagaccagcctggccaacatggcaaaacgccgtctctactaaaaatacaaaaattagccaggcgtggtggcatgtgcctggaatcccagctacttgggaggctgaggcaggagaatcgcttgaacccgggaggtggaagttgctgtgagccgagattgcaccactgcattccagcctgggtgacagtgagattctgtctccaaaaaaaataaataaataaaataaaggagggccaggcacggtggctcatgcctgtaatcccagcactttgggaggccgaggggggcgaatcacgaggtcaagagttcaaggtgactatagggagaaaaattatatttcaatagaaaaacgatagtttacctgttattatagtaatgttcattgtttgagttatttatctacctgtagactggattagattctagattcttccagttttctctaatgtctggctacaatctccagtgaagaatgagaactggctgggcgcggtggctcatgcctgtaatcccaacattttggtaggccgaggcaggaggagcacttgaggtcaggagttcaagaccagcctggccaacatggtgaaaccccgtctgtactaaaaaaataaaataaaattagctgggcatggtggcatgcccctgtaatcccagctacttgggaggctgaggtgggaggatggtttgaaccagagaagtcgaggttgcagtgagttatggtggtgccactgcaatccagcctgggcaacagagtgagaccccatctcaaaaaataaacccacacccaaagtgttggtttacagaggctttccaatgcaataggaagcttctggaaactttagggaaagaggaggattaagcaatggagtctagagaaccctcagtggcttgccactgcctttcatttccagtctagttcccctgggaggcagacaggccgagccctctgacattgctgctggaggctgtctctcctggcaaaggcccagggaaactatcctgctgaggcccatctggagctggcagggagctgacattcacggccacatcttagtcataactcctcccctcccctgacacagccacttcctctttctgctgagaaaagaagttgaatgaaggacaagctctcagaaagttgcaacccctaagaacttgagtacaaggaagagacggatgtttattgcaagaaccgttccccggtgtctcctggctcatagagcagctccaacaacacgtgcttggatgccaagtgtgccatggagaccaatccttgctataatcctgatggaaagaacttccccatctgaaaagaggatggtgataagtaaacagattgtcaggggtagaagtacccgtcggaccccaagcctggagcattttgccagagacctttttttttttttttttttgaaacggagtctcgcactgttgcccggggtggtgcaatcttggttcgctgcaacctccgcctcccgggttcaagcgattctcctgcctcagcctcccaagtagctgggactacaggcacgtgccaccacgcctggctaatttttgtatttttagtacagatggggtttcactatgttggccaggctggtctcgaactcctgacctcgtgatctgcccacctcagcctcccaaagtgctgggattacagacatgagccaccatgcccggctcagagacctcttgcatgagccatgattctaccaagcgctctactcattcccccaagaaatcacgtcatccactttttacagatgaagttacctgctaagctagaagtggcaggaagaagccaggtgtggtttgtggctgcttgggaggctgaggcaggaggaatgcttgagcccaggagttggagtccagcctgggcaacatagcaagacctcgtttcaaaaaaaaaaaagagtggcagatgggactagggcctggggatatggcttcaaggatgtctcccagcctgcaggccgcattctcttgccattccagttgatcatcttgacagggaaagtctaccggcacacgcatgcttagatgggccagtatctcccttatctggcccatgaggcctccctctccaggccaagccccactctttactaggcactaaggccttccatgcccccagggcacagattctcccatttctctcccctctttttttttgagatattctcactccaacacccaggctggaatgcagtggcacgctcttggctcactgcaacctccatctcctgggttcaagtgattctcctgcctcagcttccccagtggctgggactacaggcacccaccacacacctgactaatttttatatttttagtagagatggggttttgctatgttggccaggctggtcttgaactcctggtctcaagtgatccactcgccttggcctcccaaaatgctaagattacaggtgtgagccaccacatccacctccccatggttgaggatttgcttctggatcaccgcctccaggaagcctacctctgcaacccctaggcaattttgttttttgagagggtcttgctctgtcactctggctagagcgcagcaggaggcagcaaggctgggacctgagcagtgagtacagctcactgcagccttgaattcctgggctcaagtgatcctccagcctcagcttcccaagcagttgggactacaggcacgtaccactgtgctcggctaatttttatattttgtagagatggggtctcaccacgttgctcaggctggtcttgagctcctaggctcaagccatcttcccacttcggtctcccaaagtgctggcattacaggcctgaaccactgtatctggcgttttttgaaccccagcctgttactcccctacagatcacaccacaacctgcttaggccgcaagcggctcacccggaacaatcccttcgtgccacaagtccctggctcagtgcccttaaccactcaaatcacctaggttttttttttttttttttttttttttttttgagatggagtcttgctgttgcccaggctggagtacagtggcgtgatctcagccccctgaaacctctgcctctcccgggttcaggcaattctcctgcttcagcctcccagctagctgggattacaggcacccaccacgatgcccagctaattttttgtatttttagtagagacggggtttcaccatattagccaagctggtcttgaactcctgacctcaggtgatccacctgccttggcctcccaaagtgctgggattacaggcgtgagccaccatgcccaccccaccctgggatttaagatgcaaatttctaggtctgggatggggctttaaatgatacatttctaacaaattctcaggtgatgccaacgttcacagaccacacttagagtatcaaaggccttcctgctctcagtaggtccaaagctacccaaaccttgctctgaatgcactatagacatgtctgtacccgagtcaacacgctggaggccctgccctcagccagacgggccagagataagcaccatgccagttgcacctgagcatctttcagctttcatcagtttatgcctaatcctgctcagtaggtgccacccccatgttgcccacgaggactggcaggctcacagcaagtagccagccaggctgggatgctgcagcgaaagtgaactttcccgagtgagaatggcttgagtttggggcaaggctggagccagctactgagggatgtgaagcctcccacagaggtaccatgaacaccttccccagcaaagggggcacaagttccctgggtaccctccttggggcaccattcccttactcactcctaggaactatggctgaaacctgggggagggaagcagcctatttagggagcgcgataaaggtagggggaggttgagaagcagctccccccagtgacagtgaggcctcatgtctataatcccagtgcttttggaggccaaggagagagatcacgtgaggccaggggttcgaggccagcttggggaacatagcaagacccagttcctaccaaaaatagaataagttgggcacagtggggctcatgcctgtagtcccagcaactcactcaggaagctcaggcaggaggatggctggagaccaggagttccaggttgcagtgagctgtgactatactactgcactccagcctgggcaacacagccagacctttctctcaaaagggacaaatcaaaacaaaaccaaaaccaaagcaggttctcagctctcctgaggcttcctacccccaaagcaaaagtacccacctcagagccacctcaggaccaccggcttatgacattaggctgcctcctggaatggcttggagtgccagtcaccccttgctgcagctttgacaagttcataccaacatgtcccaagaatagcttcaagcccaaggtgacagctaagaccaggcagaagcagtgctctgatcactgccctactgggagggcccagtcatgactggccttctggcctctagcatctggacagagctgcctgcctgcttgccttggagaagtgggcctggaagctctctcctccccactcccatgtctagagtcaaatccatgggggccagagatataagattctttgctagcctagaagtaaggtgggtccagccagactgaccttcatctaagagtttccatgttggttcccatggaggtgatagattatagttgtctaaggacatgaaccctgccctgtttacagtagagacacagtagtgcttgctggactatgctatgtgagtgcacggggcgggtggtatacagtcgtccccacccgacacagtcagtactaattctgaccttccatctgaccaccacaccacgaccagatattgctttcttcttttattcggaagcagacacagggtgggaggcagtgcgacacctcctggtgagaaccaggataacagcagtcagagtcagggacaccaccacagccaggcctacgcccagcagcaccactgaggtgtcagaaggcaaagcccactgctctacttcatggtcacccctcctgtccaggaagatcagtggccccacggtgacatctgcttcttctgtcactgtgaaaggagaacacacaaccaagggtcatcttagtccctaaccgggaactgggttggaggttttattctgcctcagtgggctaaactaatatgttgtcttttttgtgtgggctaataaacagtttctagacaaaaaaacacagctttctcggccaggtgtgatggcttatgcctgtaatcccagcactttttgggaggctgaggcaggcagatcacctgaggtcaggtgtttgagaccagcctggccaacacggcaagacccgtctctactgaaaataaaaaagttaactgggcatggtggcacatgcctgtagtctcagctacttgggaggctgaggcaggagaatagcttgaacctgggaggcagaggtttcagtgagcagagatcgtgccattgctctccagcctggaggacagagctagacaccatcttggtgcaggggagggggaagaaaaaagaaaaagacagctttctcatacggagaaagcaggtcacccaagagggattccctagtacatcatcttttttgtagagacagggtcttgctatgttgcccaggctggtcgagaactcatggggctcaagcgatttccctggcctcagcctccccaagtgctaggattataggcacaacccactgttctggccagattattattattttttttttttgagagacagttttactcttgttgcccaggctggagtacaatggtgcaatctcggctcactgcaacctctgcctcccagattcaagtgattctcctgcctcagcctcccaagtagctgggattacaggcatgtaccaccacgcccagctaattttttatttttagtagagatggggtttctccatgttggtcaggctggtctcgaactcctgacctcaggtgacctgcccgccttggcctcccaaagtgttgggattacaggcctgagccactatgccaagccagattatcttaacaactgctatatttcccctacatgcctaattatgtctcagtagaagcctaggatgacagcagatctaccctggctgccaccgaggtggaaggctgagagccccctcctgcttaaccccaagatttgtgttagggaaaggtagctgcaggcctaggtacaaacagttttaatggatgacaagggaaaataccatcaccctgaaatgacagcaggtaccctcaactgagtaagggacaatgaacagcctcttggccattctatgacataccatgcctgcggttacagggaagcagacgtggaccactggctcacgacacgaggctgcctcctggaatggcttggagtgccacagtcacctttgttacagcattgacagatgtcagccaggccttccactgggaaccagctgagatgaaagagaagcagcttagatttttgttgcctgcaggaagcagtttgctgataatatattgggggaaatagacaaggggtcgccgattcagtttctactccagtcacggagcacctgtcctcacctgttggaaggcttgctgaaggaacaggccttgttgagttcatctgggtcctgctcagctagggtgaccttcaggtggcaggtgatgtatatctgcaaggaataacagctatttccaggccgagttccaggctgtgcctgggagtttaacacaccagttctcttataaccctcaaccctttaaagagtgagaaggggccgggtgcgatggcacacacctataatcccagcactttgggaggccaaggcgggtatatcacctgaggtcaggagttcgagaccaacctggccaacatggtgaaaccccatcgctactaaaaatacaaagttagctgggcgtggtggtgggtacctgtagtcccagctacctggaaggctgaggcaggagaatcactggaacctgggaggcagaagttgcagtgagccgagatcatgccactgcaccccagcctggctgacagagtgagactgtctcataaaataaacagggggaaggaagagcctcatctctaagatggtgtaaaggttcacttacccaatgttagagcaagtagcaactagttttagactggaatccaccacttattcccctgatcttttccaaacttacccaatcattgaacatgcttgaccctgggcttctgagacagggcctgtcacccaggctggagtacagtggtatgatgatgcctcactatagccttgacctcctgggctcaagggatcctcccacctcagcctcatgagcagctggaattacgggtacaagccactacacctggctaattttggattttttgcagagatgaggttttgccatgttgcccaagctggcctcaaactcctgggctcaagtgatctgtccgcctcagcctcccaaagtactgggattacaggtgccagctatccgtgcctggccagtcctgggcttaactcagcattgctaaacccgcgcccatccccaggtgaccgaggtgagtggtagacaccttaatagctagcagcttagctgggtttctgacgctgccacctgccacttgactagttgacaagctacttttcttcagggatgtagtcactgtattgccagctaaggcaagaccaagttgtttctgggacctgaggtccttgggcacataaagaagccttttggacttgcttctgtggagtttccatttcagacttaagaggttttttttttgttttttttttttgaggtggagtcttgctgttgcctaggctggagtgcaatggcacgatctcagctcactgcaacctctgcctcctaggttcaagcaattctcctgcctcagcctcccaagtagctgggattacaggcacttgccataatgcctcgctaatttttttgtatttttagtagagacagggtttcaccatcttggccaggctggtcttgaactcctgaccttgtgatccacctgccttggcctcccaaagtgctgggattacaggcgtgagccactgcgcccggccagacttgagtttgatggctcactctttgggcaagcttccctgggcttttcttccttgcacatacctctgctattagtcaagcctacgtcagtctcccttcacctgtaagggatatgacgaccagaagactcaccaggctgataccctgacagtcctggcctctgggaaacgtttacccaccctcgttagacaagtacgagggaatgaacccaatatgagctcctgctgggagctgaaggaccccccccacccagggaatagtcaactaccctgtaagcactgcccccctacccttttttttttttttttttctgagacggagtctgtctctagtccaggctggagtacactgtagccactacctccgaggtttaagcgattctcttgcctcagcctcccaagtagatgggattatgggtacccaccaccacaccaggctagtttttgtatttgtagtagagatggggtttccccatgttggccaggcttgtcttgaactcctggcctcaagtgatccacctgccttggcctcacaaagtgctgggattattggcatgagccaccgtacctggccaagccttctcattttagactgacattccatcctgctgctggggctaggggccattctgacagagccagggctcagtctagccttggcccgtccccaggtcagtttcccttcatatttcaggcagggctaaaattcctccctgctcaacctcgggcagagcatggcaattctgccaccttgcagcagaagcctcagagccacaagcctcagtcaccacctagtggccgagtacaccagcagagaaacttgaaaccatgtaaattcagacttttagaaacaagccagtttagcagttgtccagctgcccatcttagccacctgccctgcaagtaagaagcttccaaggccctgttgtctattccacaaaggaaatgtactttcatccttagcttcttcctagtatgtttttctggtgctaactggagtctaagatcccagggcagttcccctatagcggccttttagaagcagggtctaggctgggcgtggtggctcatgcctgtaatcccagcactttgggaggctgaggtcagtggatcacctgaggtcaggagtttgagaccagcctggccaacatggtgaaaccccatctctactaaaaaaaaaaaaaaaatacagaaattagctgggcatggtggcaggtgcctataatcccagctacttgggaggctggaatggaagaattgcttgaacctgggagatgggaagttgcagtgagctgagattacgccattgcactctagcctgggcaacaagagtgacactccatttcccccaaaaaaaaaaaaaaaaaagaggggagtgtgatagctcacgcctgtaatcccagcacttgctgaggcaggtggatcacctgaggtcaggagtttaagaccagcctgaccaacatagtgaaaccccatctctactaaatattcaaaaattagccaggcatggtgattgagtgcctataattccaactattagggaggctgaggcaggagaatggcttgaataaggaggtggaggttgcagtgaaccgagatcatgccattgcattccagcctgggtgacagagcgagactctgtccaaaaaaaaaaaaaaaaaaagtacacagggtcttgctctgttgagggcaatagcaccatcatagctcactgcagccttaaacacctgaactctgatcctcccacctcggcctcccaaggtgctgggattacagatgtgaaccaccgtgcccagccaccctattgctctgaaatagggttgttccttctttgtgccatgggacatagtctactgaggcatcatcaatcctacctttgaaggggagccctccaagggctcagactatcttccattaaacagcactgttctctggtcttagttacccctccacacccagagattgagaaaccacctcagtccatacccatgctgactgctaccacctctgtgaaaacttctccccatcttcttcccaaatggccacacctgaggtcaatcttgacttcctcccacaaccaggatcctctcccctaaggagctatcggtcactgatccgagggccaggactcttttcccaaatctgccctcctttatccccagccccattgaagcagggcccaccactgagagcttcaggccatctcatcaatattagatgcttttcccttttgctaccctactgatctgtgtgttgatctttctcttcccacaaggcagctgctggaggaggtgaagtggcatcgatgtcatctttgaaaagtttctactttgtcccttaatgccaccctaacgtatgagcctctgcttcagaggtttgcaagcctggctgcgtattagagtcacctaggagcttaagtggcttttgatgcatttccaagtagaataaggtaggtcagtagatggaggataacagtaaaatgctagcaggccgggtacagtggctcacgcctgtaatcccagcactttgggaggccaaggcaggtggatcgtttgaggtcgggtattcaagaccagcctggccaatacggtgaaaccatctctactaaaaatataacaggcactcagtagtggcgtatgcctacaatctcagctacttgggaggctaaggcaggagaatcgcttgagcctgggaggtggaagttgcagtgacctaagattgggccactgtactccagcctgggtgacagagaccctctcaaaaaaaaaaaaaaaagggggggggggcaggtggcacgtggtggttcatgcctataatcccagcactttgggaagctgaggcggttggataatgaggtcaagagttcaagaccagcctggccaaaatgatgaaaccctgtctctactaagaaatacaaggattagccgggcatggtggcaggcgcctgcaatcccagctactcaggaggctgaggcaggagaattgcttgcacccggaggcagaggttgcagtgagccaagaccgcaccattgcattccagcttgggtgacagagtgagactgtctcaaaaaaaaaaaaaaaaaatgctggtggtagaacctagatggtgtgcacactgaagttcatagagttttacagcaaacacctatgaagatttagttaatgttacaaaatgtgacaccaggccctaccccaatagagtgaaggtatgagactctacaatcagtatttttacaacctctccagatgattagtatagagccagcactggaaacccctactttaatcacttcctaaccacctattctaagctcacggcctcacctctcatctcagtgagcttgtttaaaagctacttgaggctgggcatggtggctcacgcctgtaatctcagcacttttggaggccgatgcaggtggatcacaaggtcaggagttccagaccagcctggccaacatggtgaaacccaatctctagtaagaatacaaaagttagccgggtgtggtggcaggcacctgtaattcccagctactcaggaggctgaggcaggagaaatgcttgaacccaggaggtagaggttgcagtgagccgagactgtgccattgcattccagcctggactgcagagcgagactccaactcaaaaaataaaagctacttgaggctgggcatggtggctcacgcctgtaattccagcactttgggagaccgaggcaggcggatcacctgaggtcaggagtttgggaccagcctggacaacatggtaaaaccttgtctctactagaaatacaaaaaaattagccaggcatggtggcgggtacctgtactcccagctacttgggagactgaggcaggagaatcacttgaacctgggaacctggagtagctgggactacaggtgcccaccatcatgcccagctaattttttgtatttttagtagagggggtttcaccgtgttaaccaggatggtctcaatctcctgacctcgtgatctgcccgcctcagcctcccaaagtgctgggattatgggcacgagccaccgcaccaggcaatttacttctaaccacttctaaccacttaccagtacttcctggctagatgttggtcctggcacctgcacttcctactgcatccctcccccacctcagccattaggcagttcccatcttcattccttccttctccttccctcttagtgtcaatttgagttttctagtttaggttctcaaggggaggacccagactggcagaaccaacacttaagaatgcagattctaggcttcactagaccacctgaatcaaaccctgggttggggcccagtcatcaatttcaacaagccctccagctgaggatgatgccttcagaatcactagcctaacctatgaccaagttcaagaagccaccctggctacgaagttcacactggttttctttgcccctgcagaaagcctccaggaaggctaacacctgcctttttttttttttggagatggagtctcactgtcactcaggctggaggtgcagtggcacaatctctgctcactgcaacctctgcctcccaggttcaagctattctcctgcttcagcctcccaggtagctgggattacaggtacccaaccaccacactcagctaattttttttgtatatttagtagagtcggggttttactatgttggccaggctggtcttgaactcctgacctcaagtgatccacccacctcggcctcccaaagtattgggattacaagcatgagccaccgtgcccggcctctacctcttaaggcttcatattgttcatccttctgcttgaaggcctcgctaaagctcatggctttacttgtaagtttgagttactgggacacagctctaagtcatttgcttaggggtggagctagtgagtgaccccattcagtaggatatgaaggttgcaagttcagccttctttcaggctgttaaagctcttaccatgtttctggagtcattagcaaagtggaagacatccactgtgaactggagtgtatctggcccgggtcgaggaactttgaatgcagaagaggcatcagtgagaccgtcgacaagacagcttggaagaaaacagaacggtgttaaagccagacaggtgggccgggcaccgtggctcacgcccataatcccagcactttgggaggccaaggtgggtggatcacttgaggtcaggagttcgagactagcctggcaaacatggtgaaaccttgtctctactaaaaatacaaaaattagctgggtgcagcagtgcacacctgtaatccacctactcgggaggctgaggcaggagaatcgcttgaatctgggaggcagagggtgtagtgagccaaaattgcaccattgcactagcctgggtgacagactgagactcggtctgaaaaaaagaaaaaaaaggaacgttcaaaatagagggtagagaatatgagaatatgcacccatttgtgttttttaaacaattgcatacaataaacgggcttacagacgaagaaagtttctgggaagagacccaagaagcccccagaaggtagggggataagctgaagaattgttaaagattttatttatttattttttgagacagtgtctcccaggctggagtacagtggcgtgatcatagctcactgcagcctcgacctcctgggttcaagtgatcttcctgcctcagcctcctgagtagctgggactacaagcgtgcaccaccatgtcaggccgatttttgtattttttgtcaagatagggtctcaccatattgcccaagttggtctcaaactcctgggctcacgcattcctcttgtctcagcctcctaaagtgctgagattacaggcatgagccaccacgcctgactgaatttttaaagatttagagagggctgtcagctgggcgcagtggctcatgcctctaatcccagcactttgggaggccaaggtgggaggatcacataaggtcgggagtttggccaacatggggaaaccccgtctccactaaaaatacaaaaattagccaggcgtggtggcatgcgcctgtaatcccagctactggggaggctgagagaggagaatctcctcaatccagggggcagaggttgcagtgagccgagatcgtgccattgcactccagcctgggcaacagagtgagactctgtctttaaaataaaataaaataaaataaaatagggctctctcctctctggcagtatccccactccccacaacatacacagtagggcagtttgccacttgcgttcttgcataaaggtccacagcctaaggggcagtggcaggagcagcggcaggaaatattcctggcaggggttctttgtctgaaattttccgcctagagatggtgtctttttttttttttttggaactcctcaaaggctggggtttgttcaacacacccaaggggccaccagtgctctgaagcaactgaaaatgaatgacgtggcccaagaaagaatgtgactgttggccacaaaatggggagtggtgttgagcaaagaaatttaaactctaatacccataatcccagcacctggctaggtccaagtgggaggatcgcttgagctcagaagtttaagaccagcttgggtgacaagacaagaccccatctctacaaaaaataaaaaaattagctgggtgtggtgggacacccctgtggtcccagctacttgggagactgaggcaggaggatcacttgagcccagggggtccaggctgcagtgagctatgacgacaccactgcattccagcctgggtgacagggtgatatcttgtctcttaaaaaaaaaaagggccgggtgcggtgtctcatgcctgtaatcctagcactttgggaggccgaggcgggcggatcacaaggtcaggagatcaagaccatcctggctaacatggagaaaccccgtctctactaaaaatacaaaaataaaataaaataaaattagccgggcatggtggcgggcgcctgtagtcccagctacttgggaggctgaggcaggagaatggcgcgaacccgggaggcagagcttgtagtgagccgagattgcaccactgcactccagcctgggcaacagagtgagactgtctcaaataaaaaaaaaaaaaaaaaaggacaacacgtgggggtggggtatggggtagagggtatttgcaaacttttcagatgaatgaacggtgagcacacgtaccttattttagatttgccacaagggaaccagtgaaaagggtgagccttttcttttgtttttgagatggagtttcactcttcttgcccaagctagagtgcaatggtatgatcccggctcatgcaacttccacctcccatattcaagtgattctcctgcctcagcctcccaagtagctgagactacaggcgtgtcccaccatgcctggctaatttttgtatttttagtagagatggggttacgccatgttggccaggctggtcttgaacttctgacctcaggtgatctgcctgcctcagcctcccaaagtgcagggattacaggcgtgagtcacctgcccagatgggtgagccctttcaaaacatgttccaaggggctgggacttacataagataattatttggggaagactggtttactcctcagggctgtaaagccatttttttttttttttttttttttttgagacagagtctctctgtgtcgccaaggctggagtgcagtggcatgatcttggctcactgcaacctctgcctcctagatttaagtgattctcctgcctcagcctcctgagtagctgggattacaggcgcccgccaccacgtccggctaatttttttttttgtatttttaatagagatggggtttcaccatgttggctgcaaagctatcttgcttttctttgttgtgcaggtcacacctgggtcctgagctggcgccatcaccggagacgccaggtgatgtccattcatcagaaataatgagcaaagcagctgtggcttctaatcagcccatccctccagggtgtcagatggaggccaattagcggacgcactagacaaccaaattctgcctttccaagcaaaacatcagaaaatgttctagcccttagcattgatgctggaacccagtgtcttgcttctgcttgggttttcatgatctttccttgctctgggtgagctgggggctggttctacatcagaaccttcagaggcactaagaaatgccacctggagtggagttaaagaagttattatttttttttaacttctactattgtcagaggcgggtgaaccagagcaactccattttgaataggggctggataaaatgaggctgagacctattgggctgcattcccagatggttaaggcattctaagtcacaggatgagatgggaggttggcacaagatgcaggtcataaagaccttgctgataaaacaggttgcagtgatggccgggcgcggtggctcacgcctgtaatcccagcactttgggaggctgaggcgggcggatcacgaggtcaggagatcgagaccatcctggctaacacggtgaaatcccatctctactaaaaatacaaaaaagtagccggatatggtggcgggcacctgcagtcccagctactcgggaggctgaggcaggagaatggcgtgaacccgggaggcggagcttgcagtgagccgagatagcgctactgcactccagcctgggtgacagcaagactccgtttcaaaaaataaataaataaataaataaataaataaataaaacaggttgcagtgaagaagccggttaaaacccaccaagaccaagatggcgacgagagtgacctctggtcgtcctcactgctacactcccaccagcttcatgacagtttacaaatgccatggcaacgtcaggaagttaccctatgtggtctaaaaaggggaggcatgaataatccaccccttgtttagcatatcatcaagaaataatcataaaaatgggtaaccagccaccctcggggctgctctgtctatggaatggtcattctttcattcctctactgtcttaataaacttgcgttcactttatggactcgccctgaattctttcttgcgtgagatccaagaaccctcacttggggtctgggtagggacccctttcctgtaacactatcattctcaagttttttttttttttttttttttgagatggagtctcgctctgtcacccaggctggagtgcagtggcacgatctcagctcactgcaacctccgccccacaggttcaagcgattctcctgcctcagcctcccgagtagctgggattacaggtatgctgtaatttttgtatttttagtagagacagggtttcaccatcttggccaggctggtcttgaactcctgacctcatgatccacccgccttggcctcccaaagtgctgggattacaggcgtgagccactgcgtctggcccattctcaagttttgttttgttttgttttagagacaaggtctcactctgttgtccaggctagagtgcagtgatatgatcacggctcactgcagcctggaactcctgagctcaagcgatcttcctacctcagcctcttagagtgctgggattataggcttgagccactgcattcaaactcgagccctttttcttttttaatctaaattcctttttttttttctttttgagttggggtcttgctctgttgccctggcgagagtgcagtagctggatcatatctcactgcagcctccaactcctgggctcaagtgatcctcccacctcagcctctggagctgggaatacaggcactcaccaccatgcctggctaattttcatattttgtttggtagagatggagttgcactatgttggccaggctggtctctaactcttgggctcaagagatccctccacctcagcctcccaaagtgctgaaattacaggtgtgagccaccgcacccagcccaaattgattgtggttttttttttttatttcacttttccccctgtgatacagccccaggagatccccaaataaattcttaaaacagtcttatgactctttaatgtcagaaatcctatctataggaacaatggtatgcaatggtcaggaactagtgccacctgacttttagcaacaaggaagtaggccaaaatgcagcctgatgaatgcttaattataactctatttctgtccagaacccagcatgcagttcttgttgctcctgtggggatagtttcattctcattgtaaatgaatattctggtgtgttgctttgggatatataagttgttcaagaaaagggatcaagcctggtgcggtggcttatgcctgtaatcccaacactttgggaggctgaggtgggtggatcacctgaggtcaggagtttcagaccagcctggccaacagggcaaaacccccatctctactaaaaatacaaaaattagctggctgtgatggtacgcaactgtaatcccagctactcagcaggctgaggcaggagaatctctcaaaacctgggaggcggaggttgcagtgagccaagatcgtgccatttacactccggcatggctgacagagcgagaatccgcctccaaaaaaaaagaaagagagagagagagaaagaaaagcaaagcacgcttggtgaccgtgctaggttttttgagataagttttttgttaaataagagcaattttgtttaagttgggggttatttaaagattgtttcaaaatatggatttaggaaggaaatagaaacaaggtgggaagaaggccagtaagtaggagagacgtgaaaaaaagttatgaggatgtatttttggtaaagaaagttgaaaaaagagtaattttttattttgcatgagagaggactttggtcaaaatcaagaggaaaggaaagtaaatttctgtcctaaagtagattgctaatataaaaaaagtataggacaaaatcaaagatttaaggaagtgtagaagttgtggaagattaatctcatgaaaggaatttggtgtgtgattaagctggccgaaattagaaggggattatttataagattttcggccaggcgtggtggctcatgcctgtaatcccagcactttgggaggctgaggcgagctgatcacctgaggtcaggagttcgagaccagcctgctcaacatggcgaaacccacttcaacttcttttctttctgtaattagaaaactattccattttcattaggttattttacaaaccacataaggaatttttttttttttcagacagtctcgctctgtcacccaggctagcatgcactggcatggtctcggctcgctgcaacctccgcctcctgggttcaagcaattctcctgtctcagcctctggagtagctgggactacaggcacctaccaccacatccagctaatttttgtatttttagtagagacggggtttcaccatgttggccaggctggtctcgaactcctgacctcaggtgatccacctgcctgggcctctcaaggtgctgggattataggcgtgagccaccttgcccttccaggaaattggttttaatctcattactgataaaactaccaaactctagttttcatttttctttcccaagcatttccttcagcacaattaagacactagaactggtgggccgggcgccgtggctcaagcctgtaatcccagcactttgggaggccaaggcgggcagatcacgaggtcaggagttcgagaccatcctggccaacatggtgaaaccctgtctctactaaaaatacaaaaaaattagccgggcatggtggcgggcgcctgtagtcccagctactcgggaggctgaggcaggagaatggcatgaacctgggaggctgagcttgcagtgagctgagatcgggccactgcactccagcctgggggacagagacagactccaactcaaaaaaaaaaaaaaaaaaaagacactagaactggtggttacccaaataactgaacaccacaaaattccgaccagaagacttagagccttctttcttgaaaataaacttttaacacgtttctacagaagcatgaggctaacatggctaatagctgtcagcttatctctgctactcacagaaaaggtaaattatgacatcgatctaacctgtgccttgaaatgatcagcattaaaacccctgttattaggttctttcatgaaagccaaagaaggaggcctatgaaggctcacaaactggaggtggcctctgtatctttacgggaatgtctacatctcatcccataggagtccaagcgggaaactggcttagtactctcctgagcctgttaccttcttttattttcctggccatcaaggaatatttggtcttcttcctccactgtccttttcttcttcttctctttgagggcactcagtacagtctcctttgcacatgggtctggggcattacttgatggtgaggacagtgttgagctgattatctgctctggtctataatgaaagacaggattctagcagtaagatattttaattcccatgccatatcagaaatggaaatcagaagctaaccaacaagccaaagtataatttatacactcacaacagttccccttagcaagtaaagctactttttcgttaacggcaaaaagtgaaaaacaaacggttttactagaatttggtatttctcattcaaacaagcagattcgtcctttcttttttgcgttgtagtcatgttgtcataggaacaactggagaagaataaagtggacacgaaaagggagagtattcttccaacgataatactcacatcgcagaacgcgaaaatcttctgtcaggaggggcgatcctcagagtcactgggctacacaccatcctggagttgcgaggggacagcacagccttcttgtgataaccattccagcacactgtgggaagtacccccggacaggaatactgggcctgatggatcggatagcgtcttcgaggtgttattacaaaccgatctggtaaagtcccacgatccctgcagagaatgcgagacaaatcatggaaacaaagtataaaagaatgtcaaaattttagacggttaaaaacccaccagttaagacattttccaaagaacttaagtctctttctacgcaacacagaacacgttgtttttatggcaactttcccctattccatctaagagcagagagtgacagctgcttaacagctgtctcaacaatggattgcaacaatttgagagggaaaatctaaatctagactaaatctagactgcactaaaattcggggagtttttagaactggaaagaagggaatcgttttggcaacacatctcacaccaagcaagagtcagaggccaggagacggctggcacacaccaaggtgttaaggagggcaaaaccacacacaattcccttcggatttgatgaaaaagcaaatcggatttaaaagtcctcgatttcaagccagccgagccaaaggatgatctgggaaaatcagcgcatctcaccgtggggaaggcctcccggagggtcggagaagaggagtggggagagaggggtaaaagtggtgaacgcgatgggtcggcggggagggcggtgtggagcgcggcgccgggcgggcgggcggcggccaggcctattccgcaggtcctggccctccggagcgggggcgggctgcggcggcccgggcttgcccaggtaactgcccatgaggagcagttcggcagggtcaggtccttcgagcagggtccgcggctctaggaggtttccgttggctgtcgacttggccggaggcgaagcgaacagtgttcgccgatgtcgcgccttctgaacgaaggaggacaaggggcgcgaacctcggggctcgcggctcagtccccaccaggccgcggtagtccccacggccagccaggccagcgcagccgcagcaggcacgaggtacagtaggaggccgaccagcgacaggccgagaagcgccgccccggccggccctgacactcgctatcggccgccgccgctcgcctgctccagccgccgcagccgccggagacatcgcggctccgcgccgcggaggagacttaaatatcccagcgtgcaccgcgccacgcgtcgcgtcatcgcgcgcccgccacgtcatgcgcgcgcgactcggggagacgctacagcccggcagctcccgagacacagctgttttggaaaatgctgcctgccttcaacgcctgtttctgactcttgcggtttcccgcatggctcccagcgagacgatcccgtccgggatcccatccggctcccatccggaggcgatcccgtgaaaggatcgcgtccaaaataaaagggcccgagacctatgcttatgtaattcctaatccgtgatcttttctaggggctgaactcccctccagcacagcctgttaccaggtgcttttcacaaacgccactggcggctgagttttcccccccacttccatttctactttacaagttgataacgtgggacgattacctaccaaatttcacatcatggcccagacatcgggtggattttgaggctctgtgatcgatttatacctatgctaaagttatcggtctgagaaagtagattagtggttgcctagggctaaggagtgggtttgggggtggggaatagaaaatgactgcttatgggtataggctttctcgtagcagcataaacatagtttaaaattagatcgtgttggcggttgcaccaccctatgaactgtatggtttgtgaattatatcttcataaagctgtttaaaaagtctggtagtctgccaatacactttggtgtagttaagtttcctcagacattcattcattgatttattcattccattgtttatatacattaaagagattaagggggaaaatagaggatctctgatctttataagctctgtttagtaaggaagatgtgtaagtaaaagattgcaattcaatgttatcagtgtgataacgggaacaaaaaaagaggccagacgcagtggctcatgcctgtattcccagcacttcgaaggcggaggcgggcggatcacctgaggtcaggagttcaagaccggcctgaccaatatggtgaaaccccgtctctactaaaaatacaaaaattagctgggcatggtggcgcgtgcctgtagtcccagctactcgggaggctgagacaggagaattgcttgagtccgggaggtggaggttgcagtgagccgagatcatgccactgcacactccagcctggacgacagagcgagtccatctcaaaaaaaaaaaaaaaaaaaaaaaagttgtgataaaggggaaggaaggcagggaagtgctcctggagctgagaggtctggcaggttcaaggaagatgaaggagcactgtgcagaagtccagagatggaattgttcagtatcgctggagattagggtgttttggggatagaaaagttggaaaggtatagatgcctctggggcaactcagagagatgagaagaaggtgcagtttgggttccagatcctccccaacccagtgccaaagtaattcttctatttaatatactgtgatttcacataagacttaatttgaaaaaaaaggggggggggcggaggggggactgtgttgcttaagaaaaaaatctcagtatcagtagactagtgggacaaaagccaggctgccctgggttgaacagtgactggaaggtgaagaaatggaggcagtgactgcagactccctactcaagaaacctgggtaataggggaagaagaaacatagtgtctaggtcagtaggggctctttgaactattgtgtgtggctggagttaagtggaggagctacacataaaagccgtcagggtacagatgtcctgaaaccaagcaagatgactgagaattaatgtaaatagagaggtccatagcctgagccctcggggcactcctgtgtttagaggtaaagagatgaatacacaaagggcacaagtcatgtaggaaatatagataaatatgactacattaaaagttagtacttctgggccgggagtgatggcttacacataatctagcacatttggaggcgaggctggtggattgctttgagctcaggagttcgagaccagcctaggcaacatggtaaaacccagtctctactaaaaaaaaacacaaaaatttgcctggtgtggtggcatgtgcctgtagtactactcaggaggctgaggctggagaatcgcttgaacccagaaggcagaggttgcactgagctgagatcgcaccactgcactccagcctgggcaacagagtgagatcacacacacacaaaaagttaacacttctgtatgggaaaagacaagatacacatctaaaagacaagccaagactgggaaaaacaacgtaacacatataaccaaaagaggattcataagtagaatttataaagaactccaaagaatcaataacaaaaagatgacccaacttttaaaaaggacaattgatataaaaaagctatcgaatgggaaacacaaatacctaataatatatacatatgtgcatatacgtacatacacatatacatttaacctcactagtaatctaggaaagactaacaatattttgcactcatttatacactagaaaaattaatttaacaagatcaagtcttagcatggatgtgaaacaaacagaactcatgccgttgtggatatatgaaacagtacaatttggaaagcaatttggcaataactagtaaaaaataagggtgaagaagtatgtatcctataaacccgcaatcccattctgggtagatagtcactgaagcattatttgtatcacagacaatgtgaacacacttcatgggtaatgtctatcaacacaaggatgggcaaactggtataattcatataataaaatactataaagcagctgaaaattaatccttccagctgcaggttagtcctcccaccataaacaactgtagacatggacaaaatgtattgattaataaatttgttaaaaaaaaatctggcagtctgctgatccagactttggtttaactcatgctgtggtggatatataaaacagtacaacttggcaactactttcaggcagaggacaacaggaagcaaaagactgatccctaagtgtaaggaaacttgtgagatgagccccaaagtcacctagttcctctacctggggatcgtttcccaactgcagtgcagagagctggagtctgagcacagtagggagatcccgctgggctgaagaggcagagatgaggaggcagagatcaggctgagacagctgaaatggcagagaaatggggcagaaaaaagaaaggagggcactatgcaaagagggagttctagaaatctatgcatgacgcaaacccacggctgaaggctggagtgatgggtaatttcatgtgtcaacttgaagggaccatggggtgcacagatacttggttaaacatttatttatgggtgtatctataaaggcatttctggatgagatggtcttttatttatttacttatttttattttttgagatggcgtgttgctcttgtcgcccaggttggagtgtagtggtgcgatctcagctcactgcaacctctgcctcccaggttcaagcgattctcctgcctcagcctcagtggagtagctgggattataggcacccgccaccacacctggctacatttttgtatttttagtagagactgggtttcaccatgttggacaggctggtctcaaactgctgacctcaggtgatctgcctgcctcagcctctcaaagtactgggattataggcatgagccactgtgcccagcctctttatttttttgtagagatgggggtcgccacaaatcagactggaaaaactcacaatttatagggctctgtgtggagtactcaagcaccccaggaatgggaaagaatcagtcttagattgagcattgctttggacccacctaatgaatcatcaaaacaagacctgaaaggatccaacttttcaatgatcttaaatacatcccaaaacaaagctcaagaaaatgtatataggaataaaaaattggctgggcgcggtggctcacgcctgtaatcccagcactttgggggggccgaggtgggtggatcatgaggtcaggagatcgagaccatcctggctaccacggtgaaacgccatctctattaaaatacaaaaaattagccaggcatggtggcgggcgcctgtagtcccagctactcgggaggctgaggcaagagaatggcgtgaacccgggaggcggagcttgcagttagccgatatggcgccactgcactccagcctgggcaacagagcgagactccgtctcaaaaaaaaaacaaaaaaaaacaaaaaaaaatgaccattactcaacaaggtaaaatctccaatgtctggcatcctggcatcctattactaggcatataaataagcaagaaaacacagcccataataacaaccaatcaatccttattttgatccaaaccaaccccaaactgacacatattaaaatgaacagagaaagacattaacattaattttaactatatcccatatgtttacaaagttgagacatggaaaaatattagaagaaataatggccaaaaattttccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaatttcttgccagaaatagtgcaagtgagagacaacagcagtgcaacttgatctttaaagtgctgaaggcaaaaactgcaaacctagaattttatgcccaatgaaaatatattttaagaaagttaaataaacatattttcagacacataaaagctggcagacactttgagaggctgagctgggcagatcgctcgagccccagagttcgagaccagcctgggcaacatagtgagaccctgtctctaaaaaaaaaacaaaaattaggccgggagcggtggctcacgcctgtaatcccagcactttgggaggccgaggcaggcagatcacgaggtcaggagatcgagaccatcctggctaacacggtgaaaccccgtctctactaaaaatacaaaaaaaatagccaggcgtggtggcaggcgcctgtagtcccagctgctcgggaggctgaggcaggagaatggtgtgaacccaggaggtggagcttgcagggagccgagatcgcgccactgcactccagcctgggcgacagagctagactccgtctcaaaaaaaaaaaaaaaaaaaaaccaaccaaacaaacaaaaagaacacaaaaattagctaagcgtagtggcacatgcctggagtctcagttactcgggaggctgagctgggaggttcacttgagcctggggggtttccttgagcctgggaggtcgaggctccagtgagccataattgtgccactgcattccagcctgggtaacagagcgagactctgtctcaaacaaataaataaaaagctgaaagaattcatcaccaacaaacacagtaagaaatgttagcggatgtccttcaggcagaagaaaaataccaaatggaaatcgggatctatacaaaggaatgaaaggcattgaaaatggtaactacatatatttatatgtgcctgtttttccttattatttaaatctctttaaaatataattgaggactgatatcagcaaaagggcagagtagacagctccaagctcccatcacccaacagaaacagaaaaaaaaaaaaaaaaaaaaaggccaggcgcagtggttcacacctataatcccagcactttgggaggccgaggcaggtggatcacctgaggtcaggagtttgagaccagactgaccaacatggtgaaaccccatctctactaaaaatacaaaattagccaagtgtggtggcacatgcctgtaatcccagctactcgggagggtgaggcaggagaatcgcttgaacggggaggcggaggttgcagtgagccgagatggcgccactgcactccagcctgggcaacaagagtgaaactctgtctcaaaaaaaaaaaaaccaaataattattagaaacaactctgaaaaacagccaaagccttacaacaaccaaatgaatgctgaatcaagaaaaaggcaacttaaaaaggaaaggtagaaaacctttgtggcaatgttttttaagagacaggatcttgctctgttgcccaggctggaatgcagtggcgtgattgtggctcactctacccttgaactcctgggctcaagtgattctctcacctcagccttccaagcagctgggactgcaggcgtgagccaccgcacctggcttctacgggagtcttgaagacagaaggctgcattcgcagtgtggggcctcttggcattccacagggacggggcggaccttaccttcaaattactggtaaatctgctatcgcacgtctgagggctactgagggaatgatgtagacgcctgtctatttgctggaaactcactgaggctggaaaagtggtgagcattgctcaaaaacattgcaaggcaaacaatctacacaggactggggcaaaacctgacagttgagactcacaacactccactgttctctctctttttttttttttttttgagactgagtctcactctgtcacccaggctggagtgcagtggcacaatctcagctcactgcaagctccacctcccaggttcatgccattctcctgcctcagcctcccgagtagctgagactataggcgcccgctgccacgcccggctaatttttttgtattttttaatagagacagggtttcaccgtgttagccaggatggtctcgatctcctgacctcgtgatccacccacccgcagactcccaaagttctgggattacaggtgtgagctaccatgcccggcaacagtaggggaaagagctgagttccattctctggtgtccttaaagaacaggaagaaatgccagagatggccaggcacggtggcttatgcctataatcccagcactttgggaggctgaggcaggcagatcgcctgaagttaggagttcgagaccagcctggccaacatggccaggcccgtctctactaaaaatacaaaaattagccaggcgtggtggcaggtgcctgtaatcccagctattagggaggctgaggcaggagaatcgcttgaacccgggaggtggaggttgagtgagccgagatcgtgccactgcactctagcctggagacagagcatgactccatctcaaaaaaacacaaaagaaacaagcagaaatgccagagacgtgcagagaaaaggtcacatgaagacacagcaagaaggcagctatctgcaagccaatgagagaacactctgaagaagtcagccctgctggcaccttgatctttgacttctggcctctagaattgtgagaaaataacttccagctgttgaagccatggtctgtggcattttgctatggtagcccgagcaaactaatagagacttcctaaatccgagaaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgggaaagcagggcagtcacaagcactcagttgttacacgggctttgcccagggcaggatgcttgctcagaaacacctgacaaagacctaagttttcaccttggcctgatcacgagggtcagtgcaggcctagctaagtgctgaaggaaagctgtggtgcaaaggcaaacttcaaagactgggagaggtactttcttccatttttagctcctagtattcaaggaaatctcttaccaaaatgtgagctgaacacatgctaaaagaatcagagacttcagtgaccacacatgaaaatgataaatctttgcaaaaatagtttggaagtcactaaacgtatgtactactacagccttcaatgattaaaaacagacacactcacaaatacatagcaaataaaattagaagaatcatctaaatgccagagttactaccttgcaatattcaaatgtccgtgtttcaatgacaatcgcaaatcatgcaaagacaagggaacgtattcaaagtaacaaaataaattgatggaaatcagcccttaggaagcccagatattggacttagcagacaaagactttttaaaaactctataaatcgtgaaggacctcttcaaggagaactacaaaccactgctcaaggaaataagagagtacacaaacaaatggaaacacattccatgctcatggataggaagaatcaatattgtgaaaatggctatactacccaaagtaatttacagattcaatgctattcccaacaagctactgactgtcttcacagaattagaaaaaactactttaaatttcatatgaaaccaaaaatgagcccatatagccaagacgatactaagcaaaaagaacaaaggtggaggcataacgctacctgacttcaaactacactacaaggctactgtaaccaaaacagcatggtactggtaccaaaacagatatatagcaatggaacagaacagagacctcagaaataacaccacacatctacaaccatctgatcttcgacaaacctgacaaaaacaagcaatggggaaaggattctctatttaatggtgctgggaagactggctagccatatacagaaaactgaaactggaccccttccttaacaccttataaaaaattaactcaagatggattaaagacttaaatgtaaaatccaaaaccataaaaatcctagaagaaaacctacgcaataccattcaggacataggcatgggcaaagtcttcatgactagaacaccaaaagcaattgcaacaaaagccaaaattgacaaatgggatctaattaaactaaagagcttctgcatagcaaaagaaactagcatccaagtgaacaggcagcctacagaacgagagaaaatttttgcaatctacccatctgacaaaggtcagatccagaatcttgtatattcttgtagatccagaaactacaaggaacttaaacaaatttaccagaaaaaaccaattaaccccatcaaaaagtgggcaaagcgccaggcacgatggctcacgtctgtaatcacagcactttgggaggccaaggcaggtggatcacctgagctcaggagttcaagactaaaaatacaaaaattactgaattactctactaaaaatataaaaattagcctggcatggtggtgggcacctataatctcagctacttgggaggctgaggcaggagaatctcttgaacccaggaggcggaggttgtagtaggctgagatcgcgctgctgcactccagcctgggtgacagagtgagagtccgcctcaaaaaacaaaaaggctgggtgcagtggctcacacctgtaatcccagtgctttgggaggccaaggcaggcggatcacctgaggtcaggagttcaagaccagcctggccaacatggggaaatcccatctctactaaaaatacaaaaaatttagctgggtgtagtggtgcacacctgtaatcccagctactagggaggatgaggcagaagaatcacttgaacctgggaggtgggaggcggaggaggagccgagatcgtgccacttgcctaggcgagtgagactcatctcaaaaacaaacaaaaaaacagtgcatgttggctagtttgttaatcaatattagttagttattagctccgaatagatgtcaggtaatatggtaggcactgatgacgtattcatgacacaaagctggtcccaatgctagaatgatctttgttcgagatccaggttgctgctgccactagagggcagccgaagctcatctgtaatggcacagtaatggttaaccccaacaatctaacattaccagggaagaactgtcctgaagggcaaagtaccaagctacctaaagtttgtattgattctctcaagactattgctaacaaaatggtaaaatgggtcaagtttgtgtttggaacccctagcctctcatctcttcaccctcttccctgaagaggtggagagaataatacaggtaccacctgtaagtaaaaagtgtggcagaaacagtcagttgcatctctcaccaacaggtgggtcggggggggagggagaggagattcctggagaggaacggatcaagctaggaagcacagaactgcaggccagagacaactctggaagcagaaacaggtgtgtgcttccaggcgcacagacaccaactgtgtgacacccacaccttctactcacaaactcactattgacagtgcaccaccacctgctttgtgcaacacaggaaacaccaataaacactggagacagtgtcaggccaggcatggtggctcacacctgtgctcccagcactttgggaggctgaggtaggaggatcgcttgaggccagaagttcaagaccatcctcagcaatacagagagaccctatctctacaaaaagtttaaaaaaaaaaaaaaaaagatacaggccaggcgtggtggctcacgcctataatctcagcactttgggaggctgaggcaggcggatcacctgaggtccggagtttgagaccagcctaaccaacatggagaaaccccaactctgctaaaaatacaaaattagctgggcatagtggcgcatgcctgtaatctcagctgcttgggaggctgaggcaggagaatcgcttgaacccgggaggcagaggttgtggtgagccgagatcatgccatcgcactccagcctgggcaacaagagcaaaactcggactcaaaaaaaaaaaaaaaaaaaaaaagacacagtctcattccttaatgagtataaagaagtaaagtgtttcagttactaattgcataagaaaccaatctaaaacatagtggcaaaaaacaatcattatcatcagggattctgtgattccaacaggcctggcttgtctctggtccacacgacatgtggggcctcagctgggaagacatggagtcttaagtgtgatcaatgggagggggctggaatcatttagaggcatcttcattcacaaaaccaggagctgatactggctgtcagccaggacttcaactgacctgtgggctggaacctgtccatgtggcccctcgcaatctccccatttgggctggtttgggcttcatcacagtccagcagcttacttctaagtgcaagcattccatgacaacacagcagaaaggcatgacatttttacagtgcagcctggctatctcatagcgtcgcttctgtcctactttatttattggtcagggcaatcacaaagatgtgcataggctcaaggaaaagagacatacccccgaccacgcgatggaagaagtgacaaggtcatgttatgagaggagtgtgtgggatgggagatagggctgtggccacctgcagaaaatagcatctgccacaggctgtcatggaagcgcaggatggggatttagcctacctgaggggtcagtcagcaaaggcctctgggacgaagtgagatcttcggctgaggatgtgaggggctaaaaggagactgaggaagagtttcagggagaggaatcaatgagactggattccagagagaggctggtgagttggatggtttgcttcaatatgatggcaatacagagggcaaggagactggtgcaggaggagagagaaggtgccatgtgctctgggtggcgctctgtgccggacccccttagaagaggagcagcctccagtcagcggtgtcccaggaacacagaggctggagaggacaatggcagccaatccctgctcccaatctggtgacagtagggaaaagctgcatggtctagatccaccctgctccctggccccagtatagaagatcaaattcaatctgcccaatcttatccagataaagtaaaggaagactggaaaaaagaactaatccaaagctccatctgcccatgattttctctgctgatgccggaggcagctatggataaagagatggcacacggcatgtcccgacgcagtggaggtggggagaccctgcaactccacagggaaggagtgaagttgctgccacctgggcatcagctattctctgctcttctgcctcatcctcaattcagaccatgatggagctgattttcctccattttataccttggattgaatggtctcgagctgctggtcttgtctccagagtcacatccaagaggtttgtctttcaaataaatgctgtgtatcaatgtacagtgtatataattaatgtatgatatcagactaaattatagataagacaagagatgaaattagagttaagtagggacccgatgacgaagagccttgtaaatcagggagagtctggttcatgtgcttctccagacacaatttcaacacggctgtaagcatgtaccactgatgacacggacactgaattacccgccgtgctggtctgtggctctcaagttttgctcattctgcttctgcgggaaatgccttgacgcaccttgggaaaactcacttagacctttttttgagatggagtctcgctctgtcgccaggctggagtacagtggcgcgatctcggctcactgcaacttctgcctcccaggttcaagcgattcccctgcctcagtctcccaagtagctgggactacaggcatgcaccaccatgcccggctaattttgtgtgtgtattttagtggagatggggtttcaccatgttggccaggatggtctcgatctcctgacttcatgatccgcccgctttggcctcccaaagtgctgggattacaggtgcgagccaccgcaccgggccagaaaacccacttatcttttaagattcagcccaactgtcaccacctctgggaacctgtcctcagccccaaacatatggccaccctccctttggggtccccgctcgcccgtgtctattttcattacattcctatcagtttactgcactgtgctgcatatctaccgtgtctattttcattgcattcctatcagtttactgcactgtgctgtgtgtctatttctcccactctggcctgtgggctctttgaagacatgggctgtatctcgcctatcttttgatccctcacataggatatggtgcgtggcgagcactcactaaaggtgtgcagagtactgcatgaggaaaaacttcatccaggccaggcgcagtggctcatgcctgtactcccagcactttgggaggccaaagagggaggactgcttgagcccaagagttcaagattagcctgggcaacatagcagagatctcgtctgtaccaaaacaacaacaacaactagctgggcatggtggcgtgaacctgtagtcccagctactcaggaggctgaggcaggaggatcccttgaacccaggaagtcaacgctgcagtgaggtatgatcgctccactgcactccagcctgggtgacagagtgcaaccctgctcttaaaaaaataggaagttcatttataaacagaagtgaacaggaatctgactcttgtactttggtgggagtttgggttatcttttacttgaggctgaggctatgccaaaactagggatgtaataacaagcaccatgtaccgagtgctgcttctgtgccacaggctctcctacatgcttgccacacattcgtctatttcatcctcccaatagtcctactccatgtccagcaaggagtgaaaaggctgaggcgagtcacagggagaagagggccccagtgaacagacgaaatgaggaagaagatctggagaggtcgcacgagccagagcgcaaaggcacagtggctgcggtgcaggctctttagcaaggtgctttgggctggagatggggttttactgcctgttgcgagatgggacatgagacacaatcaacatgcaaacgggtaggatgtttcatcacacggaagcaaaatgtattgccgctaaaatgagaagtaacaccctgaaggttatcaagacaacaattttcaatgccaaatgttgtttccagttccataggagatggaataagcacacccattacatttctcttctaattacaactaaaacccctgttcaaaatacatgaagcagctgggcacagtggctcatgcctgtaatcccagcactctgggaggccgaggcaggtgaatcacctgaggtcaggagtttgagaccagcctggccaacatggtgaaacccgacctctactgctaatacaaacatgagctgggcatggtggcaggcgcctgtaatcccagctactcaggaggctgaggcaggagaactgcttgaacccaggaggtggagactgtattgagctaagattgcaccactgcactccagcctgggcaacagagccagactatctcaattaaaaataaataaataaataaataaataaataaataaataaatacatgaagcaacaatccaatcaatcaaaccaacaaattctggaaaggtagagaagagaagggctgacccagtggtgagttcccagggtggtttgatggtttgttctttggcctcctatataccctgtcttatctgttagagcggagtctacaaccaggaaatcccagtgcccccttcatcccccaacccccacaaaaggagcctcatctttcgagccaaatgacagcgaagagggcggccctgcgggacagtgcccttttgactacacacaccctactctaggaaaacagcctgaaaaaagctgcaccttcccctgccccagatactgtagacactgtggaacaaagacctgttgaccctccccaccttgggccaacacaagcagaggtggcatctctcccctctccaccaagcactggcaagactgtgtggaagggccctgctgaccatccacaacctgcacaagactgaaccacagtaacaaggtggcaccccatcctctctcaaagacagtgaggagctagaagcaaggattctccaacccatttcccgttccccgtcccacccaccgcagaatactcctctctaatcctaatataacgtcatgtacatttctgttacattcggattaaagacaagttctgtttaataataactccaagaacagttgatatatattttttttcttttagaacaggagtgaaagtttattaaaaagctttaaagcagtaaagaaaggaaggaagggaaggaaagtacacttggaagaaggccaaacccagttttcatattttattttcgcattgagaatcagtcagatttacttcagcctcaaaagtgtgtttatgtaaaattaaatgagcactagcagcaagctgcactttttttttcccaaatgggaaacgggttaaatatgtgtaggaagtcctgggccatgccctccaagtgcccatgtgtgaaaacaaccaggatcaacacagcaaaagctctgagagctcaacggcaatgtggaatactctgaggtttcaaactggcctccagggctgggtgcggtggctcatgcctgtaatcccaacactgtgggaggccgagatgggaggaacacttgagcccaggagttcaagatcagcctgggcaacagagtgagaccttgtctctactaaatataaaaaattagctgggcgtggtagtgtgtacctctggtcccagctactcaagaggctgaggaggaggagtgattgagtctgggagattacagctgcagtgagctatgactgggccattgcactccagccagggcaacagagcaagaccctgtctccaaacaacaacaaaaacaaaaacaaattggcctctgggttgcacaaaggtgggggaggccagaggagctctgcaaaaactttgaaaactaaattgatcttagaaccagagccctgctggccacagaaagtgcatcctgaatctaaacaggttgagtgcctgctaatacagaatatttaaacaggaactacagtctcataacataacactcaaagtgtccaggataaaattaaaacttactcctcatactaagaaccagaaaaattcgaacccagaaaaattactcctcatactaaaaaccagaaaaaatctgaatgaggaaagacaattaacactaagatgacaaagatgttggaattattgcatagggattttagatgagctatcttataaatggcccaagaagtaattatgaacactctcgaaacacactgaaaaatataacgtctcattgaagatatacggaagaactacattgtaattttagaactagaaattacaataactaagtaaaaaactcaatgggtgaactcaatagcagaatggagatacaacagagaaaaaaattagtgaccttgatgatagagcagcagaaatgattcaatctgtatcgtgacaatcttgccataagaaaaaaaattacgtagaaataatcccatttgaccaacagagagaaaacaaatagaaaaaaaaactgaacaatgagacagcagcaaaagctctaacattcatgtcactgaattcccagaaggagaggaaaaagagtgcagtgcccaaaaaacatctgaagaggccgggcgcggtggctcatgcctgtaatcccagcactttgggaagctgaggcaggaggatcacttgaggtcaggagctcaagaccagcctggtcaacatggtgaaaccccatctctactaaaaatataaaaattagccaggcatggtggtgcatgcctgcaatcccagctactcgggaggctgaggcaggagaatcacttgaaccagggaggtggaggttgcagtgagctgagatcacaccagtgcactccagcctgggcgatggagtgagactctgtctcaaaaaaaaaaaaaaaaaaaaaaaggaaatgaagaaaaatccagagagattttttttcagaagaaaaagtataaaaattaaattaaaaaagagaaatttaaaaaagcagtaagagggtaaatatctgggtgaatataatctcgagtttaaaaattatatttgatgggcaaaagcaaaaccataacattatctcagtggttctcaatgaatgtagaggtgatattcaagacaacaataccataaagaagggcagaggggcctagaaagcagtagagtttctacattccacttgaattggtaaaaggttgatactagccaatgatcataagtatgtataatataatctctacagccacctataaaatcctatacaaaaatatatactaaatggcatactgaattgatttagcacggcatatgaagttaaatggcatactaagaaatgtctaagtaccccataaaaaggcaagaaaagggaaacaggtataaaaaaacccagagggaacaagtagaaaatagataataaaaacccgtccaaaattaaatataaatcttctaaacacagcaatcaaaaaggttgttggaatctgtttttttaaaaatgactcatggccaagtgtggtagcttatgcctataatcccagcacgttagggggccgaggcggagggaatcacttgagctcaggagtttgagaccagcctgggcatgatagcgagaccccatctccacaaaaagaataagaaaaaaaaaagattagccaggcatggtggcacacacctatagtcccagctactcgggaggctgaggtgagagaatcactcaagcccaggaggtcaaggctgcagtgggccgtgactgcaccactgcactccagccaacagagtaagactctgtctcaataaataaataaatatcaatagtcacataagatggcagagtaggaagctgtagtgtagagatcagtcccttcactgaagcaaccactgagctagaaagagtgattggaatcagctcttttggaattctgaaacatgaccaggaactcctaacaaccagagacatacttaaacaatgaagagagaggctgctgatcttcacgagtgagtggcatgtgccaaccagccaacactcccccattcctgagcctgagttcccgaagcagctggctgatgccagggcgagcagcagaactctgtcctccaaaaccgtgggttctgcaccttggtgggtccaatgggtctctgaggaccagcccggatgcttgccttggtttatttggccctctcagcaacagtggcttccccagggacatccttcagaagattttattaaagagacaaaatcctcctctgccccaccccatttaaagccacctatttaaggaaatccatgttaggtggctggctgactgcagagataatgaaacaaatttcagtgaccacacaagcacaaggaagaaacactttgcaaaaatagtttggaaaagtaacaaaaggggagctccagacctcaacaagcaaaacccagcaatcccaggtgtctgagagaatcacattttgagggtcattacattgtaacacttaaaatgcaacgttctcaacaaaaaactacaaaatatacaaagaaacaggaaataggaagcttagaccattcacaggaaaaaaacagcaaagaaaatcagcaaacaatacaataactgaacaccatcatcgaccaatggaacctaactgacatttacaggagacttcacacaccaacagcagggtacacattctttgcccatggaagattcagcaagatttaccagaacctgggtcataaaacaaatgtttttctgagatggagtctctttctgtcacccaggctggagtgcagaggtgcaatcggcttactgcaacctccgcctcctgggttcaagcaattttcctgcctcagcttccaagtagctgggattacaggcatgcaccaccacgcctggctaatttttgtgtttttcagacggggttttgccatgttggccaggctggtctcaaactcctgacctcaggtgatctacctgcctcggcctcccaaagtgatgggattacaggtgtgagccaccatgcccggccaaaacaaatcttaagaaatgtaaaataactgaaatcatacaaaatatgttctgtgactgtaaaataattaaactaaatcaatttaaaaaagaaaccagaaaatctctaaacacatggaaattaaatacacttctaaataattcatgggtcaaagagtgagtcgcaagggaaactggaaaacatattgaattatgtaaaagtgaaaatataacatgttgactggtatcagcaaaaatggcagagtaggtatctccaagtccccatccccccacagaaacattgataaaccaagcaaaactgtctgaatcaacttcatgagaactgtagaaaaataatcaaaataatcaaaggtttacaataaccagatcatctgatgtggctctttgtccccaagcacatctcatcctgaattgtaatccccaggggtcaaggagggacctggtggaaggtgactggatcacgggcgcggtttgccctatgctgttctcgtgatagtgagggagttctcacgagatctgatggtttttaagtggcagtttcccctgcactctcccctctctcctgccagccagtgaagagggtacttgctttcttgttagctttccaccatgattgtaagtctcctgaggcctccccagccaagtggaactgtgagtcaattaaacctcctttctttataaattacccaggctcaggcagttctttccagcagtgtgaaaactgactaatactccaaatgaacactgaatcaagaaaaaagcaacttcaaaatggtaggaaaactgggttattttacttgcccttgccccacaaccttccatggttcagtgggaaccttgaagatggcagcccacattcccagcgtggtttctggtattgaaggcagcagagcagaccttattctcaaagcattgtgttttcctgttctcagctgcctgagggctgccaaaagaactgatacagggcagctgcctttgtttcacctaacccagaactcacacagggcagaaaagtggctacacagagggtattccttgaaaacactgtaaatcaaatgcataccctgctgatgcctaggcaaaagattacagttgaggcaaactataggtgtgctgacagcatgggagaagaagctgtggagagtttctatgggaaatttgggcactgaaattcggacctgcccatgtgtactatggaatttcagtagccatgcacatgctgagtgcagagcacattctcagaatagacctgagaaaggatgctgagctttcatctgtggctcctctccatcctccctgcaggcagggagtaaagcctagggcaaagctgtacacagactgggccgggtgcggtgcctcacgcctgtaatcccagcactttgggaggctgaggcgggtagatcacttgaggccaggagttcgagaccagcctggccaacatagtgaaaccccgtctctactaaaaaatacaaaagtaagccgggtgtggtggaaaattagccaggcgtggcggcacaagcctgtaatccctgctactcaggatgctcaggcagagaatcacttgaacctgggaggcagaggctgcagtgagccgagatcgtgccattgtacttcagcctaggcgacagggcaagactccacctcaaaaaaataaataaaaagttgtacacagactggctaagccctgaaggactgctccagtgccccagcacagtggcaatccacaaagacggaaagagctgggtttttctttttttttttttttttttacctttggcttctggcattcaagaaaatctctgttaaaacactagttgaacacaagctaacggcagagagactttcagagaccgcacatgtaaaagaagacacactttgcaaaaatgtttagaaagtcactgaacaaacagctacagcccacagcaaaagcaaacccaggggtggtggggaggataaaataatttccagttaccccattataatactcaaaatgtctgatttccttttttgagacggagtcttcgctctgtcatccagactggagggcagtggtgcgatctcggctcactgcaacctccacctccctggttcaagcaattcccctgcctcaacctcctgagtagctgggattataggcgcatgctaccgtgtctgactgtttttggatttttagtagagatgggatttcaccatgttggccagactggtcctgaacttctgacctcaggcaatctgcccacctcggcctcccaaaagtgctgggattacaggcgtgaggcaccacgcctggactctttttttctttttaattttactttttctttttttggggaaaagggattagaggtgtgagtcactgtgcctgactccaattttcaaaaaaaaattacaaaccatgcagtgacattaagagagtacagcccattcacaaaagaaacaaattgtctttaaggaagcacagacattgaaagtactagacaaagactttaaatcagctgtctgaaatctgctcaaaaagctaaaagaaacgatgaataaagagttaaaggatacaaggagaacaatgtctcaacaaatgcagaacatcaataaagaaatagaaaatattatagacaggtgaggggcagtggctcatgcctgtaattccagcactttgggaggctgaggtgggcagatcacctggggccaggatttgaagaccagcctcagcaacatggcgaaaccccctctctacaaaaaatgcaaacaatcagccaagtgtggtggcatgcgcctgtagtcccagccacttgggaggctgaggtgggagaattgcctgagcatgagaagtcaaggctgcagtgagccaagattgcaccactgcactccagcctgggtgacagagtgagaccctgtctcaaaaaaagaatttattatagacaaactaaagcttagagaaaaaaagaaaggaaaaaaatagaaattattgaaaggaatcaaagtctgaagctgaaaagtatacaaaaattagccaggcatggtggcgggcacctgtaatcccagctactcgagaggctgagacaggagaattgcttgaacccaggagacagaggttgcagtgagccaagatcgcaccattgcactccagcctgggtgacaagaacgaaactccatctcaaaaaaaaaaaaaaagaaaagtatagaaatggaaatgaaaaattcaccagactatttcgaattcattagagcagatggaagagagagtcactgaacacatgaagacaggtagatgaaactatcctgcctacagttcttttttttttttggatggagtttcactcttgttgcctaagctggcaagctggggtgcaatggcgtgatctcggctcattgaaacctctgcctaccgggttcaagcaattctcctgcactgtgccaggcccgactcaggctacttttttattttttttttgtagagatgggatctcactgtgttgccagactggtcttgaactcctggtctcaagcgatcctcctacctcagcctcccaaggtgctgggattacaggcatgagccaccacacccagtccacataccattttaaagtgttacaattcaggctgggcacggtggctcacgcttataatcccagcactttgggaggccaaggcgagcagatcacctgaggtcaggagttcaagaccagtctggccaacatggtgaaaccccaatctctactaaaaatacaaaagtagccgggcatggtggtgcatgcctgtaatcccagctacttgggaggctgaggcaggataattgtacaaacaaacagcccacaacaattctctaatggtgagggagtaaataagtgaccgataatgctggaggaagaggaagtgaatgggtccccagtataggttagaatgaaaaaatccctaccaatgtaaatcaaatataaaataaacaaaagagttcatgtatgtgtgcgggaaggaaagtgatatttgggggttgggaggtgtcactgagggtaccgagtacatataaacaactctttagtcactcccaaaggtctgggatgagcattttttaacatttgatactctactaacttacctggactatgttgacatggaaattcacctcccgttatccacagctcctctccctgctccaacttaatgatgacgtttggcttggtgatatcatatcttgttaatgggaaaagaagaaggacttgggcaagttgctcggcttcagaatctctgaagtacaagatgttgccacctcataagctgcataacagaaatgctccattttttaccttatcaaagatagaacctttcaatgaagaataatataaacactgcagctagtgcccacaaggaattaagtggtgttgtcacttatttcttcaaactcaagcataaaaccccattcaactgagagcattcagaaagcaagctatcctcacccaaggaaactagatggctgtagttctccaacatcacatccccgtatgttatcttctcatcagggtccagttgccgccactcctcctgggtgaaatccacagccacatctttgaatgacactggcccctgtaatggcaacatgatcagaattgggagatatggaaaagggatagggggataacattttacaaagctcactggtgaagttaaccatgaacatcgtataccttattttatgttacagattatggaagggaaatcatattggaaacacatatcctttggggtcctttatatatatacaaaaataaaaacccaaaacacccacctcggcctcccaaagtgctgggattacagcaatgaaccactgcacctggccaaaaaatttaaaaattttaaaaataaaataaaaaataaggccaggcacggtggctcatgcctgtaatcccagctctttgggaggctgaggcaggcggatcacgaggtcaggagtttgagaccatcctggctaacacggtgaaaccccatctcagttatgttatggagactggcttatgcacaaatctttctaatggttatatataaagcacttgaagtctctattattttataataggcaatacctagataaataatgaatttaactcaaaagagatggggtcaaattgtccctctttgcagacgacatgattgtatatctagaaaaccccattgtctcagcacaaaatctccttaagctgataagcaacttcagcaaagtctcaggatacaaaatcaacgtacaaaaatcacaagcattcttatacaccaacaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaaatggaagaacattccatgctcatgggtaggaagaatcaatatggtgaaaatggccatactgcccaaggtaatttacagattcaatgccatccccatcaagctaccgatgcctttcttcacagaattggaaaaaactactttaaagttcatatggaaccaaaaaagagcccgcatcgccaagtcaatcctgagccaaaagaacaaagctggaggcatcacactacctgacttcaaactatactacaatgctacagtaaccaaaacagcgtggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagagaaaaacaaacaaccccatcaaaaagcgggcgaaggacatgaacagacacttctcaaaagaagacatttatgcagccaaaaaacacatgaaaaaatgctcgtcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgcggcgattcctcagggatctagaactggaaataccatttgacccagccatcccattactgggtatatacccaaaggactagaaatcatgctgctataaagacacatgcacacgtatgtttattgcggcattattcacaatagcaaggacttggaaccaacccaaatgtccaacaatgatagactggattaagaaaatgtggcacatatacaccatggaatactatgcagcaataaaaaaggatgagttcatgtcctttgtagggacatggatgaaattggaaaacatcattctcagtaaactatcgcaagaacaaaaaaccaaacaatgcatattctcactcataggtgggaattgaacagtgagatcacatggacacaagaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataataaaaaaaaaagaatcttcaaacctaatgcctagaacattttatcaacattaaacttctatttaaagtttattcttagctatctataagaaacgtttacaggaagcagaaaagataagctctttctaagttaaaagagtatatttgcaaattgaactttcaaaaattgataaagcagtacacacatttatttttagaaattgaagctgcaaagctaagcaatttcctactatgacatgtgtgttggacagtgtagggcatagcaatgattagtgattttcagcagcctttcttgaataggcattgaaaatagctaaacaaaaaaagagaagtgagctgaattcttggagtgaatattttggagtgaattataaaacagagttcttgcaataatgcatgtaaattaaaaataggttagcaaagcatgagtaaaaatagtcaattttcaaatacttttcacagctctccgagtctgacatatttctctggctaaaagggaagaaacatatcggcactcatgttgggaagaccttagaacagcaaagtactaaaacttgccaaaccaacttcaagtggctttcttgttagtgcaatacacactgcactgagttcctgagcataatatttccaccctttcccatggagtctgcttaaatttgaagatttttttctggtaggtgtattgtccttaattttggaggaagttttaaaaaggtggattaatgttatatatgcttctgagaatattatgcaaccatgaagctttgcacttcaacataaatgaatcccaaaaagagccagatgaactgttggctgggaggcagagccttaggatgtttcaaattcattgtgacttcacataaaggtactctctggagtatgaaagtcaattttacaggtgtaaaataaaggaaaagaagacagtctgaaagtcaaatgaaattccaggaccacctgtatttcagtgaggtaagtgttataataaagtgttatgggtagatacataaaagacaactaatttagagtaaaaataaattgggggactattaagagactgtcttaacgtggaatgaattttacagagtctttatggtaacatttgtagataaaaattaggttagtaaagcataagtaaaaatagttaattttcaaatatttatcacagagctctctagtttacatttaataatatattctgttgcattggattgatatgcacaggattattttgtctccacgtaggggtaggaaagaaaacaaatttgttttgcaatagcccagtttaatagaggtggtacaaactttaggaagtattttaattttagttaaattgatccaggttaatttggagacagttatgaagcacatacaaattacaaatcataaaatggtaattgtatttgcagttgtaagaacccaaaagatttaagctccattagctaagaataaaatgctgataaccatgagtcgcagccatggtttggatgtactcagaaaagttaactacgtaaaaaatgtcaccttcttattcagcatattagctccctgggtgttttcaagacatatctgctggcttttcttttaaaattacacttcccttagctacgctgtgatattacagctatggaagagtgagctggcttcaccctgcctcatgcatcatcagccgaactgtcagtaaagtgctaattgcagaaactttattacttgaggtgatactgaaccagagagaacacagcttgatttttcataatctaaactttgcaatgtgagcaattagaaaaaaaaaaactttcctttttgtttcaatttctaagctaagcaaaattaaaatggatgtcattgacagtaaaatagaagcttaaaaatgttgtccttctaggtgactttataacttagtataaaatcccattaacccctttttataaaaatgcataatttgaagcttaacagcacttgcaattctatgacacatttggctacctgtaattggtgaaagacagaactttattttctgcttctgtcatttttgtattttttgtagaggaaatatacttcaaagatatgctttatatatactctctaaatttatatatttcctgtgggatctgaaatatttaaagcacctttaaacactatttcagaaaatgggtttgcaggtagcacaaggaatttcctctagaaatataaaaatagatgaggatggtttaatggaaaatttattggaatagacgcatggaatgttgggaccatttttagggcaaattccatggggagtgattagaaaaatcagcaaatataattccatgtgaaatccttggggaaattcagtatacaataaaacacatgagtgggatatctaaatcagacctaagggtctaaaaagaaaacaaacctatgatagcctcttaaggaggagaaataattagggacaagatggtagaaaaggcaaagaaaggaaaaatagttttctcagtgtaggaaacaatgtacaacatccttgggattatttctcctttttatggttgtaatgtagaaagactgaaagtcaataggagtaaattctactgattaagtgggtggtgtggattagaaggacactggcctataaagttaactgtgcaaaatcttgaaagggcttgcgagccacgctagagaatttcaaattgatcagaagggcaataggaaatcatatagggttttgcataggaatttaacatgagcagatttgtattttttaggggtcagtcttattgacatctggagagttgcctggagagagacaaggctgaaaatagggaaaccattaaaaaagctattacagcaatccacataggctatgatctaaggcacagctggggtggtagcagaaggaacagatgaatttgaaagatacttaggagataaaatcaacaggtaaatgactaggtgtgtgaggcaagagagacgggagattcagaaatggcacttgggtttccggtcaggacaacagaatggacggtaatgtaatttgctagaacacaggaaagagagtgggtttgggtaataaaggtgatttcagccatggacctgttaagatttcctatgagatttacatgaaattaatgtaagttgaatagtggatcacgaaatataagccagatggaaaggaagtaaaaagagaaagttgatgataggaggaaaggagaggggtcaagatttggaagtatccataaattacatggacaagtgtggaggagtaaccactagaggtccgagttggtaagagattatgctcagaaagtgggatgtctgcattcatgaattcagaagtagacatgtcctggtgaagacaagtgcacaggtggctgtgggagtggttggctgaagtggagttaaggtaagggtccttggaaatgaggcactagcagctcaactcagtgctggggtttcactttcctggagttcatgctgctatttcatttggaactcagatgcttttagggtactgagtatgttttcactaatatctgtaccttaatatttgtgcccatacacacagggggtcatgtataaaattctttggtgggtgattctgctgtatctaattatctcatggagaaaatggaacttactgaagaaaagaatggcagctcttctgcaaataaataagcagatacacataagcttgtaatacattactgttaaaaccagagaaaagaacctgctttataattaatttaattaacatattcaccactattggattcagtttaatttaataaaatttggtttaaaagtgctggcatagataaaactaaatgtttatataaacaagcatttgaacagctgagggaaaagattgatcgttgagggctaaaggtttaagagccttatagaagatggaacaattgatctgaaccttagaagatgggttaaaatctaaactagggaacctatactatatactaattatacatttaataggcttgggttcgaatcctgactctgcctctttctggctgtaagcccttcttcaaattaattaatctttctaaaaataaatgttctcatctgtaatataaaaatattaatagtcttacttataaaatataagtacatttaaaagcttttgtcctgtagtaattgactgaagtacaagcactaaaaatgttaatcatcaaaagcataaagattatataatatagaggttatatatagagaagaaattaatatattttaaaactgaacatttttgttgtgaaaaaaattataaaaaatttaaacagaattaaaaatgcatttattgtatcccaaatattggcaaatgatatcatcagaatataccagatggttgataccattagtgttgcccaataattgtttattttcatttatcagtacacagataattatgctttcctttctacttgaagttaggtgtggccagtgattggttctggccagtgaaatgtaagtagaaatatctccttcaataaagcacttaattacttgaccttaattctccaattctcttctgccatgcaaacctctaagcctggtgttaaaatggaattatcaaaaaatgtagaacattcaataacctggttgtttgagctccagatttctaattcacatgtgctgaccatgagcaagagccaaatgggcattgtttgttatgccacataatttaaactgtactaactgataccagttataaggttctctatctcaaatgagagaatagattgagagaaagccatgttatcttttatctaggcctgggcagacatatattaactgcgttgataaataaatatgtgtcagacacatattgataaatcaagaagaaaatagtaaagttaagatatataataaatggtaacataattttatcctcctaacaaatacatagacaatgatgtagttaacattatccatattaaatagtttatcatcttaaaaatcattttctaagtttttaatttcatgtgacacagatagcatttcctctttccatgttgcctcccttctaagagctatagtctgagaccaataatatagcataggttaagtatgaagcaaacaacctgttaaatatatcagggttctaggtatgatgaaacgcatgataaaaggcacaattaggagtgagaaacacatgatgaaataaacctaaatgctctttctacttggtgggtagcttgatgggttccccttccctgatagaatgaaaagtatttgttgagaaagtaaaacattattgacatttgaatacataacgggaaagggctaagacacaaaagggtgtttatggcaatcataggtaatgtctcaactcaaaatgtggagaaggttaccgtagtgaagtcttcaaactgtcatctaggtatctaggaaccacaggcagtaaggattgcgtctggatgttactgtgcctctgatgataccactgccatttcagtagagtggatctccatgtcaagtggatctatgctaagagtccttggcacagatttctgatcccttcaatcctgaagaattggcatgaatagttccattttgctttgtggcaatagttctgactctgaagtcaaccctaatcacgaaatatctctgtgaattgaaagtgaacaagagatgtcaatgaaaattctcagtgcttctcagaactgtaaggcctccaaagaagtgtaaatttaggaaggctatgcagaaaatggcaggaggatgacggttcattctccaccctatagcagaagtgatctttgaaatgttggtctgctcatattatttccactgttacttaaaacccttcaatggctttccattcctcttaaattgatggccatgaagaacttcaagataaaaagataaaatgacccaaaagacaataaatgatgtgaacactgtctacctttccagctcttctcttattatttccttatcatttccttccctggagccatcactctagatcagccatgcttcctcccaccatgaagatcttacacatgcaattatctctaccaagatgtttttccttcccttcccttcttagtagttcacactgcttatctctcagccacatgtcagctatcatttcttatggagtcttatattactccttggctaagtcacatcctcctgcaacagggttttgtaccactgaggacctcccctttgtggtcattgtcagaattgaaatttaataattgtgtaggcataattcattgatggatatttgttgttatacatatttttttattttgctagaaggtaaacactacaaaaacaagaggatatataggtttccatttagcttcttttgccagtgtttgctgaagggtcaaacaagtggcagattttgaatacatattggttgaataaattaatattgttgaacactacgatgataccctaatgaacagatgtgccttctgactcacttaaatgcttaaaataaaagtcaaggtattttggagggtgtagatgacacagacatccttcaaaatgttgcagttcactattcagagaaaaatgtggaatctgatgttagtcttttaagttgagggaaggagagtaaactgtcaaagcagtgcttgtcatgggaattttttctttgccacggttcataaatgaaaggtaaggaatgagtcaccatgttgatagtgcattcaacctctcagatactctgcaaaaaggattttatacattctggcttaattaggatccttaggtaatatcttagtctaaaaaactaaatacagtggttaactaggtcctctgtatatttcagtcagtattgcagattatattttggagaagtcttagtactttttcttgccttagaaagcaccatggtagtggacatcacggaaccttttccaatgattcagaacactgtgatgcctcatggttgtcatcttgtaaatcagttattatgggaaatagaaatataaatttagaagatagagcagattgaaccaaatgacccttggatataacttgaaaaaagttctgtttaaaaccttccaggagcttccaacacttagaatgatatcccagcctttaccagtgcccagtaccctggaatctggttcctccctgtccatccaaactaccttcctgctgttcccacacctgccaaattccatccctctttctggaaaaatctcccactagaacttgagaagcttcagtcacatcatttagatttctgcttgatagcttctcctcagagaggctttccttgagatcctgtggaaaataccatagtagacaacctggtcactgtctatcacatgagcctactttattttctttataacccttactacttattgaaattatattatttagggtgtgtgtgtgtgtgtgtgtgtgtgtgtgtgtgtgttttaatttttattgttcatctcctggactaaaatatatgctcaaagagtaacaatatttactctattctctgttttatccccagtgcttagaagaacatatggcccagattccacactcagtatataattcttgaatgaaaaagagaaatgaatcaagggcctctgattccatgaagccctccccaactgcccaccacccatgacatacatcacttaagcagattgatcattcctctcctatcccattaacagtttacatttcttgggcaggcagtgtctaagacctttatatatgttgtctgatattatttgtcaggctgtcagactgcctgattctgaccaaggagaacagaaaaacaggtaaattttagtctcacgagggtctttagaacatatattaaccatgcattcatgtaagcatttataaacagccttacaagtagaagaattccaagagtacccttttggaatttagacataaaacattataatgccttttggaacagctaaagtcaggtaacacccaattccatactggttgtgtgagtgtgtgtgtgtgtgtgtgtgtgtaattgtttgtggacatgcagatgaaatacaacttgatttattaaataactccagacctgtgtcataaatttcctttctacacttgcgccctttgaccctaatgtgccaaggttatacagtggagataaaagcaccaaggacttcatctgaatacatgaatatgcaaacaggcaaaaatatgccctatgcacctgaggaactacagggaaaatatgtctgctgtatttctcaggactttaattttcagagacatctctaggactagataggacaaaaagaattactggccaaactaaaacagctaagggcaaggcaaactgaagtgtagcatagccctccaatataaggcatctgagccaggtacttaacatgctatcaggattcttatagggatgtatgtgttaatttttctcagtccaaatcatttatgtccactgacaaatggggaataactgggcttaaaaatctgtaaaattaaatctaaaaatgatttttaaaataatagtattctgtccacaattcaacagcaacaattattttcatcagtctagcaaaagacaatttttttaaaggtactttaggtaaaattttcataaactattttggtttcaatgatgctgtattgataccatcgttggtttctgcaattatttaatctaattaacttgagttctccctaatgccttaaccaaaaatatgtattaagcatagtatatgtacagtattgaactaactttctgatataaataatactaaagaagtttggacaagagaaacatgttccctcttcaggacagggcatttcaaacaggtgaagaatcagagtttagtttgtttgtttccccagtccatcagagaccaatatttttgtaaagagaaaaaaaaagtgaattactacaaaaataaaataaaaaagacatccaaaatacaagtctaaattatttagtttttgatttatcagggataaaattacatttcaataaatataaccaaaacaacatttcataggaaaaagggaactatggaaactcttcaaattgttcatttaaaatgtgtatgtaggtagagaatcactattatgcccatattttttttcttttctcaattgtaactgaacaaacagttatatgtaaaacaattcccgtgccaaatacatttttgcacatcttgaatgaataccatggacatcaatatttaaagttttcaaaggtggcaaatgaacatatttcttacttcctcatttatctaatttaaattggattaatgaatttctaaattttgatcttcacttctgtacttattttatcacaaaccataacaaacagcaagaatgtaataagagaattagaccttccccacaaattcttgctgctgtggcctcttgaactctcttctctgtctcctcaattcagcaagaccttaaatctggtgctgccagttggaaaatgcttccacagagttagtgcctgtaattgtaggcctcactttgtttaatagccttctcgcatggatcatattcctgcactatctgttgaattcctgcaataaatgtctgaaaacatttgtttcatatttttccccctattccctagttgtttaagaaggaaaggtaaattcagcttgactaggagcagaagttccatatcttgcatacattctacactgttatattttcattataaatcacaccaaaatattttctactttgcttgattttttttacttaaaccttgaaatactaagaaatgtattatttaatattatgcagttgggaagtttctaattttatttttattattgacttctagattaatttcttctcatagcataactgagtaacttcaatccttagatattgttgaagctacctttttggcctagcatatggttaaatttcatacatgtatacttaatatataccttgctttccgcaggtgttgtgttttctatatatcgattagttcatgtttaaaaatttaattattcgtaccatctcattttttgttttgccagttctatcagttatagagagaagagtgttaaataattgcagatttagaccaggcacggtggctcacgcctgtaatcccagcactttgggaggccgaggcgggtggatcacgaggtcgggagattgagaccatcctggctaacacggtgaaaccccgtctctactaaaaatacaaaaaattagccgggcgtggtggcaggcgcctgtagtcccagctacttgggaggctgaggcaggagaatggcgtgaacccgggaggcggagcttgcagtgagctgagatcacactgctgcactccagcctgggcgacaaagtgagactccgtctcaaaaaaaaaaaattgcagatttattcttttcttttttaggttctgtagtatgtagctatggtagtggatgaatacccatttggtattgtgctatcttcctattggatagactctatattttaaaatgtccctcttatctctagtcattgtcttactttgacttacattaattagcacagcagaactagctctctgttggttagtgattatcatgctttcttccattatttcactttcaaccattctgcattcttatatttaaagtgtattcttataaacaatatatagttgttgttttatatcttaaacataattgttttttccttaataaatttgatctattttcatttaaaataataatggatagagctgtgattatgtctgctatcctgcaaagtccctttttaactgctttcttgatgacttttgattttgtcaaatattgtgagaacgtttttcttatattaactcattaactacaactactttgtagtgattaccctagagagtatataactcattctatacttattacaatttaaaacaagctattatttatcactttcattatactacttgaaccatagaccttttaactccattactccccaacttcattttgcattcttattacttttacagtggacacatcttttaagattttgctgatgcataatgttggcttaaatatttcctgttgcctagttgaactaaacatatcatgatagtatttagtgaggaaatgtgtctgataccagaaattgaattcaatttattaaagatttcttggcatctgtcaaaaagttcatcaaaattttccgctttgcccgtgtaatatgattgattatggaaatctatttttgaataatgaaaaatatttgaatcttctcagagactatcacttaataatggtactttctgaatttaaagctctgatgaatttgacttactaatatctttcactttgtatctctctatctataacctaaatttgtctgtagattgctgtatctttttttgttctgtttatttaatatttattacaagcttgctaacagcatcatcctagcttaaaaaattaattagaaagtttctgttcttttctccgtgtcttggaagggattgaaaagcaaagaaattgtgtcttcttaaaagtttgcagcactgttcacaatagtcaaattatgaaatcaaccattaatgtgtccatcaaaggatgaataaataaagaaaacgtgataatatattcacaatggaatacaattcaacccttaaaaagggagaaagtcaatcatttgtgacaacatgaatggaattgaagaacattatgctaagtacaataacccaaacataaaaagacaaataccatatgttcttacttatatgtggaatctaaaacaactgaactcatggaagcagcgagtagaatgatagtaaccagaggctgggggtggggtagtggggaaatgatagtgaagcctcagtaaggaagaataactttgatttttttttgactaattgccaacatgatgaatatagctaataattaatttatatattacgatatcataacaagtaaatttctaatgttctcatcacaaaagaatattaagtatttgaggtgatggatatgtttattagcttaatttaaacttttcatattacattcaaaaattataatgccactttttacttcataaatatatacaactatagttcatcaatatatcataaaataatttttttaagtttgtagaaactcaactatgaaaccatctgggtcatgaaactatttgaacaatttctttattctgtataataacctaactttatgacaaaaagtttactatttcacttagtgtttaaatgtcttaagcacaatttcatgtatgtaattaatctgaaaaaacatttctatgacagtgattgtatcacctttcatacactaatattgtgaattactattctcacgcattttcccatgagtatcttttagagatttatctatttcattatagttcttaaataactagcattagatgtattttcatttctaacttcccttacttatgttattatctttacaacttcctttctactgatttcatagtgatcgaggcaggaggcagacagatgcccaggcagataggggcaggtcccaatgaaacccaatcttcaagttggaaactgttcctggtaaatccttggaccccattaagaacctgccttcctgtttcatgcactatcctctgaccttgatccccatccttcacgtattttacatatccctaccctttcttaattgtttttctacactgtagtgcccatctttgaatggtgttcttcactttgaccttttttgcatactcacaaacaaatcagcacacactccctattctgagctcataaaaagccccaggctccaccacattagaaaaccttcctgtcttcaggtaggagaaccaccccacccctcccgtgtcacctgtttttgctgagagcttttctttcccttaaattttactccactcactctttgaggtttgcgtgcctaatttttcctggtcatgagacaataacccaaaccgagctgagctaaaagagcaaacatcctaaatcaataggagttaattcagtgtactttcttatctccctgttaatatttattgctgcgaacaaactataggagattttgcagcttaaaacaacacccatttattagctcactgcaagtcagaagtttgcgtgacatcactggtttctcctctcagtgtatcatagggctaaactcaaggtgttggttatgctgagtcttctttggaagttctgaggaaaaatcagcctccaggatcattcttgtttgcaaaattcatttccttcctcttgtaggaatgaggtcctggtgttctttttgactgtcaacccagtagcttctctcagcttctagagtccccccacattccttgctatgtgacctctccgtcttcaagcctgcaacactgtattcaatcttcaagcctataacaatatgttcaatccttcctatgctttgaatctctgacttcttgtctcttacctctggacccagatttaaagagatgacatggttgagccaggcacaattttcctatcttaaggtcagctggttttagaccctaatttacactagcaaaatccttcacaacagcatctaaattggtatttgattgaataatgggaaaaggtgtgtgtttatcaacagacagaaatcttgggagtctcatagaattctgcctaccacatttctatgagtggcatatttagctcatttatttttattttccctattttgcaggcataaattttcagagtgcatatcatatttgtctgtgtttcctactttttgatatattctgtcttgagaagttgatatcctctttgactcaagagttctttaggttattatttttggttcctatgtgatttaatatgttccttaagtaatgcttttgttattaatgtttttatttcactgaaataagataagtagaattgttatgatttattcttttccttttgagtttttttaagacccaggatataatcaatatttaaaaatacctcatgagtatttgaaaatattttttaaaaatatatattttctgcctaggaactaaaacattaattatattattcaatttcttaatttcttcatttgatttctgattattttatcttcagaaagtttgaaaaataattattttcccatttattttttattttgaacatttaatatagttcagagatatattatttgtctcatagatgacttttgatagctaaatcttcatgttacagtacaccttttatcctcatataatacctgacaacatgctaaacaaagaattgctatgatgattataaatgatgatatttgtacaatatgatattgccactaatgcttttatttgtaattttctttatgtcacattatttttcattttgtatattatttagctatcagtcttcatgtattttcgttgttttttgttttgcaatctaattcccgagttttcaagtagtagggtttaacactttttttttttttcagttgggcttgcttctgttatctactatatattttatgctcttaagttttcatgctattccccagtcagttcactgattttgctatactattcaaagtttctttcgtttttgttttctagtgatttgagaataatatacctatgtttattctaccagtgatttatcttaaaattttgagcataaatgtatgaacatacatgaactcatttttaaatttattttcctctagcaatagagaatgatctttttaataaaataaaaccaataatctcattttcccacttaatgttctttctatttttgaagataaaagtcaaaattttagcttagacatgaaggcccttcattaactgagtgatgtctctttctcttgcgttgtaacttctgttctccttctctttagctatgttctgttgtttcaggattccgacattcacactgctgttatgcaaaatgctgtttttcaaactgaaatgcttgtgcttctcttttacctgctaaattctattcaaacttcaacattcagttcaaataattatgtcccctggaaaacttttcctagtcacattctccatgcaatctgattttaaaaaccctctccttcactgatgtggcactctgtagataccccatcacaggacctatcatcttgccctacattattaggttactcattcatcttctcttcttcttggagctcagtaagggcaggggctttgtcttattcagctttgagccctcagaatctagtgctgtccttcacatatttgtggtacttacaaatatttgtttactgaattaagtatattagacaaatatcaccagtgtttgcccatttttggctcaaatattcagaaatttcatttatgtttataaaatacacaatgtaattttctgatttattctgaagtaccagaaacaaagaaaaaatagaaaaccgaatatattataatgtaaccaatgaactttagctaacaatgtatcagtattggttcatcaattgtaataaatgtattatacaaatgcaagatattaataatagaggaaactggggtaggcaagtacatatgagaactttctgtactttctgctcaatttttctataggacaaaactgctctaaaagtagtcttataactaaaaacacctgtttatatatttcaaaatatattcaatattataactgaatataccttaccttactatttaataatagctcttttacatattaatttaactaacatattgaacacctctatgcccataagacaagtgagagaccaagtgttgcttgctacatattgtgataagccctgtcaagacagtattttttgagagcacgtaggaaacctatcaatcctagacctgggtaggtgatccaagattccatgatggaagtgacacctccaaggaagcctgaatgatgagaaggagtttatgagtaaagaactaaaaataaggaaaatagaacctggagaattaaatctgatcctgtttcagagtttgaactttaatccagaggtaatgtgatgccactgaaaagattgttaacatgtacatgacataatcagatttcctttctagaaggattactttggatgctacaaagaggaaagtggatgagaaataggcaagatcagatggtatcaaagcaaggagacaacttatgaagcttttttggccatctaggctaggaatgatgattctctaaaatggagtagtatcaataggaatagggtgatgagaatttcacagcagatcaggagatagatggattggatacaagtgagaaggaggcattcagggtgattcttcagtctttaactattcaactgggtggatgtcctcatgccattttcagagagagaaaagatagagagtaaatttgggtaaaggaattgaaaatgagttacatttgggatttgaaatatctgcagaatatgcaaatgaagacctccaactgagaaatgaatgtggagatcctggcctatgtaagggaattgggtcattaaaagacagtaagaattgtcagactatctcaataactgaagaaaggggtgtgggcaaattagcaactgaagcattggatattttccccactatagagatatagagaattattacttcggaaatacaacaacaacaaatattttctagttgagaaacttcatagatgtttataccatatttttctctttggtgataaagtgattttagaagtaatttatatttatttttaagttggcattacatctttttgaagataccaggatatttactgtagaatctccaggctgccatccatataatggatcccaaggaccttatcactttcttgacagtaagaatgtgtgtactttaatgaagttgttatcaattccatcagatgtaatacttactttgataataaataatgtggaatgctccctctactatcctgaaattaaatatacacataatacctacacagataattaaaaaatacagtgccctaaatgtagtataaaggaggagtaaagacaactaataaagttaatatttctctaaaaaactgctcaacgtaacagcactagaagacataatgaaataatcagatacttaaacccctaggtgtaattacaatgaagttgtagctataagtgaaggttatgtaaacttcagaaagccatgtgtttattctacttagttcactgctatttcctttgtacctggagctatgcctgaaacatggtatgtgctcagtaaaaactttattaaataattgaaataataaattcaagtgttccttatgattttaaataccactagcagcactgctgtcagtgatgtgatgtttcaaaatgtggatcaattctcagtgaatttccaagcaatagtttgcccagttgttgcatttaagtattattactggtttaattgtaaattgttaagtactaatccatgagaataatcactaatctgaacaaatttctttaaaatagcttactattaagtactttacttaaatcagcaataatgaatttgcactaattggtcacctattatgtacctgatagtagagattgtgctctcacacctgtatatctttacccttggagaggcatttactacataatttttgagtaaatgatttcttgcaacaattctgctttgtgagtgttttgccacttttaaaaaattgtctttctgattgctatgtttaagatttgattactatgttctattactgatatttgaagtaacttaacagaactatctggtttatttatctacaaaaatatatattttacccagcaatttaagactatgtttaactcatcattatttcaataagaaatgaaaaatacattaaacttatatttatcatagtcagttccctgcccatttccctttgggtcctttatctcttctatgagtggcagtctgactccccacccatactgccatctgtactggaaggctgtcctctgtttccagaaccttctttgccaatgcacagctgaccagaaatgtctgggggctagcatgtctctgagagcctttgccagtgggtttaataccctaggttgctcatcttggcaagaataatcctgaggcatgtcttttcaccttttctcagagctgacctggggattgtgctccagaacaacttgacggcctgcttttcccttcctgtatcatctccacagtcctctgcttgtttttcctgcagctcccaaataaacaaagggtgtatcatccttttctcagggtctgattctcttagggtcacctaattaaaggagttagaaattgttctaggaaacagatcctcagagagaactttggggttgggtcttggggctggccagatagcaaaagactgcattgctggtggtagtcgggataatgataatctttgacattctatagcataaccattaatgcccttttcaccagtggtgaaatgaaatggaatatctgtggaagaggatgcaatatcactgatatttaagaggtatggtggcaacggtcattacagactgtggaattctttcgttgttttaaaattctattaataagcgaaattaaaatgctgacaggctcaaatccgaaaacagataccttttcccggtggggtgggaggggccaaaggggatctttgacagtatttaaagattccttcatctcctgcaactagagggcagatcaggacaaaaactagacccagcacctaattgtgagagtaggtgagttacagagaaggcatgattcctagtacttatgtctcctctgctgaataaagggcctaggtgcaaaaagaatgtgccctggctacctgggaggggaatatctgagcagacacacttgagaatacttaatcccccattcccttgaatcctccaaggctgcagaagaggtctgcttctcttgcctggagaccttgcagaggcctctgctgagatggatgcttcccccaagttgataatggaattttccaagatttccctccacttcccctcatcatttctagactaatagctggtataaagtttagtaaattacctcctctgggaagaaagggattcttccatccctcaccccctcaaaaaaaaaactatagttcttgcaaatatgtactgacagggccccaggaatgagttttgagggcactagatgaatggagggaaggtgttgagtggcatgcagaatataaagctatacaggggagagtttgtaaatataagaaacaatctaatggtacagtatgcaacatactgacaaggacacctggagcttgttctaatttgctactaaaatggctccctgaagcttggggaaaaaaatgctggcctctaataaatggatggagatgctgaaatgccttggcagaatagtgtggaagaattaaaaatccttagagaggtaggcgtgctagaatgaatttattcactatctgacctatttctcaatgagagcccagaggactctccacttagtaaatcaatatgggatgagctagtaaggatggcaccaacactgtgtcctttctaagccagggtcgatggaggggacactgctttggaactggactccccagagtcaatgaggacaataggattcaggcacagcagaaccctgaggctggcattaaacattaaagaaaaattgtaagtagctaccaaagtgtagcaaagctgcaatggcaaacacatttgtattttgcagcatctaattatgatttttacgtaaaacttaatacaaacctacctacattcattatcataaacttaactgcatatcagtatcttaaaataatcttcccatattaaatgtttgtgaaaaagaaatcaattctagtcatcagagagcccttgtaataaatatgcaagaaaaacaaattattgacatttcctggaaaggtgaacattaattttgttatacaaatttcatgactgaatatttagtattgatctttccaggccagagtttttttcaactttatttttatcttcaaatttttactttctttaacatgtgtcttcatgatattgaagcagcgtcatttgtctggggtgatacagaggttcgttgtctcatggccacagaaaactaggacatggacacgcgaagagtgaggttcagagcagaagtttaataggcaaaagaaagagaagagctctcttctgggttaaatgcagcaggttttatagatgatcctgaggagacagtgtctgatttacatagggcacaaaagattggttggaccaggtatgtcatttgcatagggcacaaaaaactaattaggactaggtgtgccatttgcatatggcgcaaaaagctggccacccccaccctgatcttttattatgcagacggattttctaccttgccagcgccatgttgcctgtttgtttactgtacacctggtgacaaagaaaagggaagatagagcctccatgttgaacctacctggcccccaggtagctcttttctattggcacagctgctggcattcacccatgcaagcttccagcttgcttatctatgtctgcagctcaatttttcaggctgctctttgttagaaaagaaatgatttgggggctgctttttgttaaaaagggaaactgcaccaaggactcttgcccttactatctgcctaaacagtttatttctatctcctgtatcaatattccatgcttctctgatagaaaaaagtatgtatgcatgtgagtatgagatgttaccactgttcactaacaggactgaagatattaccactgttcactaacaggagtaaattgatttatattctagtaagaaacgcatataacaaaccatcccagtccctttttgggtatttcttgcctaggagccactttatgccaagagaagtgatttattggcattatagtgttaaatattcccccattctgcttaagtggccgtatttaaatgaagtttaagtactccagaacctgtggaagcattagcagtcaagtgggccagtgctttctatttttcagtgtgtgtatttgggtagtagatggcatgcatttgtacttatgtgtgagtcttcctgtgtattctagtgttctcaaggcataacaaggtacacattttatcaggtttacttaatatttttggctggtagaccccctattaaggtgattattttcattttaaaattaatataaatttattttgggaaatccaaaaatatatcttgtttaaaaatatcacgaacatctttgcctctttatagtaatccaagtgtgttttaactcacttctttgtttatttgttgtatttatatatttgctttttatagtgattatgcaactccaaacccttccttttcatttatgaaaatgatatatatatatatatttttccaagagctagcgtctcttatataatatttaatggcattataaaagctcaccgaatgtatatactataattacttagccatgattctatcataaacagagattctgtatcagtcagggttctccagagaaagagaaccaatatagatatatagagagatacagatatagaaacagatttataaagagattaatcatgaggaatttgcttacttgattttggagactgagaagtcccatgatctgccctctgcaagctggtgactgaggaaagccagtgagttagttctaatctgagtccaaaggcctgagaaccaggaggctgatggtataagttctaatccaagtccaatgtctgagaactggggagaagatggtataagtttcagctcaaaggcaggagaatatggatgttctagcccatccagtcagggagagagagtgaattctccatttctctgccttttttcttctattcaagccttcaacagattgaatgcttcccacccacgttgggaagggagatcttctttccccagtctattgattcaaatgctcacctcatccaaaaacaggtatttgtttaaccaaacatctgtgcaccccttgacccaatcaagttgacacataacattaatatcacaggacacaatcctactgattgttcagaattattctgtcatcagtatttgtgcttattttatctttttgttcatgtttcagagtttataattaatttcttataatagatttccagatatggaattaccagatcaaattgcataattaactttaaattttcagctgggcacagttgctcttgcctgtaatcccagcactttggaaggctgaggcaggaggatcacttaagcccagaagtcggaagaccagcctgggcaacatagggattctctgttgctacagaaaactttctagaaattagctgggcgtagtggcacacacttgtggtctcaactacttaggaggctgagatgggtgaactcatgagcctgggaggttgaggatgcagtgagttgtgattgtgccattgcactctagcctgggcaacagagtcagaccctgtgtcaaaagaaaaatcataattgtctcaaattatttctggaataattttatcatactatatttgaccacacatttattattatgtacgatttcatatgcttaattttaatagaataaaaatttatatttcattttccccatgtgcttattaacgatttatatgttctctttctttaaacatcagatcatattccttggccacttatctattggaattataggattttttgattgatttctgaagtcttcatttattaatattgttactattaataatattgatatttcatctaatgtgacctacttaattgtattaactttgtattctttttgaacaaggttctaacttgatgtaccaaaaatccatttttactgtaatatacttaaaatgataaccatctcattatcttgtgatttaatgaattattatttttatttctccctgaattcatgtttgaatgtttgcatctcatatcttattttggaataatatatgagttgagtatataaattcattattttctaaatagcaaactgattaccaaaacagttttattaaataatctgtctccttctcactggtttgtgatacctctatgactgtagtagttctcatggaagataaggtctaattcttataaatatgttttgtagtgttcatcgaggtctatctaattttgttagtaccatgttcacttaagtattatagttttataacatttgatgtctattatgtcttgctcctcattttaattttttgaaaactagctctcctcatatgatttaacatatggaatttgaaattttaatttccagtttttcaaaaattatttcttttatttataatgaaattacattaaataaataaaataatttagcatgaagatatatttaaatatacatccctcttgcttgaagcatggtgtatctatccaacttcttaagtctgctttaattctctctatatttggtagttttcattaaatatacactagacgtgtttcattgaggttacttttaggtattttgttaccacaaatgggaatgcaattataggcaaagcaagcagaaacatacggctttgatgaaagctctaatctcaacactgtccatatatatttgaccacatcattagacctataaaagtttgcattcaggcaatactccagattttatttgatctcatttcttgttttgagccatctggcaagtattcacaattattgatggcaagaatttctcaaactggatcaataaaatgtcttccttcctaaatcccagtggaatacactgaggactgtggggaagctgatttacttaaagattccgacagttctgtagaggaagtaagaatggaggaactaaaagctctgtcacaggctcactgttccatctatactttcccttcctcatctcattctcaccctgagcaccaaccaccatatgatgtagctgctgtccaaatataaatttctagtccaggtcctctgatgaaccatagcataaatatatcttcactcagacaagctcaatttgtccaaaactgaactcaaaataattttgctcaagtaggttacttctgcattctatatgggcaatggcactactatccccccagctggttatgcctaaaagagactatcttagttttttgttcctttttatttccccaagagtgtagtctccacgtctccttaacatctccttagtgcagaacctcctctgcatcctatctgctactgccttggtttagggccccgttttccctctcccaggcctgagcaatagtttccccacacttcctcctctatagtcagctactcccaccatctatccttcccactttagacaaagggaactttctaagaagcaaatcattgttgttgactttttctcccttccaaaatacttcaatggctcattattaacttaaggagaaaaagtattctatttacctggacaactatataatatcttgcgtattactcatcctgctaagtaacccttagttaagtgaaagcatttgcattgctaaggtagtaacaggaaacagagtgaaagaaaatagtctgccgagcctggtggctcatgcctgtaatcccagcactttgggaggctgaggcaggtggatcacaaggtcaagagatcgagaccatcctggccaacatggtgaaaccccatctctactgaaaatacaaaaattagctgcaagtggtgcgggcactacttgggaagctgaggcaggagaatagtttgaatccaggaggcagagactgcagtgagccaagatggcgccactgcactccagcctggcaacagaacgagattccatctcaaacaaaacaaaacaaaacaaacaaataaaatagtcaataatcaggcattgaacattcagctaggaaacctgagggaatcagcacagtttataccagaatccagctcccactccgggagagataagaagaagactactactgaggcttaggacagtgtagaggaatgaggaaaagcgacctaaaattttcgtgtctgggagaagagggaatgagcagtggctgaggggagcaggaggtcagcatggagagaaataaggagacagttttggtggccagctcaggggctgtgtgaaatcattgaatgggagtctcaccaatggcagaagccaagccaatgcctgatttttgtgcttaccttcaaactgcctgttcctcttcttcctgtcttcagtggttttccatcaacagcatgccatttgtggttcattcagaaaaatggcattctggccccatgactttgcttactttttatacaggccacttggcatggccattctccagtcccttttaatggtccaaaacatttagaagactaagaaacagagagtgaagtgaaattaagtcctgaaagagccttgtgtatcagggaaatcctcagcactcctacttggagggacggcactgcgattaaagcacttcagtgacatgtgcatacacttagctctccaatgtgacctgttcctgtgacctcccttgcttcaacctagtcacctgttctagttacccgtagatacaccaggtggtgggaaactttgacaacttcaccagcactcttccttctactgagaaactcccttccctatcccacataattttccagtgcacacgttaatcttgcaagatcatatctttttaaaaagtgtctgtctcttaccttgtcatacacatgtaaataaaaaggtgcaacaaagtttttgggtattgaccctccccaccattccacccacccacctccactcacctgtggctccagcctccggagcttatccatctctctattacaacaagtactccttcaagcaaatgttgaataaatgaatgaaaggacaaacaaataaatctgttctgtcaatccttaacagccagctgaaggcttaaatcagagaacttaaattgcccctgaaataatcactgcaatctgtactactcttcagacaattccctatttctgtcaacctacccctaactcaatatttaactgatttctaactttgtgtctcaactacgtgatgctttccaaaactagaattaccttggcagctaggtttacagacttcaaagaaacctgatgctgctatggatggaaatagggggcaagctggtttgtgtggtgagtgccaaggttaagtaaatagacatagtggagccaaacattcacctgcatttcaatatgatcagatttacacacacacacacacacacacacacactcttaaagttagcgatttatgctatgagaatgagaatattttagacttgaggaaactcaaatttaataaaacctgtaagatggctggctatgactttatgtaagctgaataaacatatcttcattcagactgatacttctgcctttcttctttgagtctctaatcatccaaagccaacttttcagttcctgaatgctacaaattatcttctatgaaagtcattgttttgtctatgaagcttatcataacttcagggaatttcacatttgcatttctgatggactacagtctaaggtgttagaaaattggtttcagctttccccacctttttttttttccactgtgaagcagctcattacaaaatagacacatttctaaatcaaatactcgagttattattgatgcatgtagagaatagagatgatttggttaagaaatgcctaaaagttaccttcttgttcccatgattttctagttgattgaatgatttatatgctcaattccaaatttaaatgtatggtttttaatcatcatgatatagttagtggaaggcttttaacctttacatttaagaagcccttagtacaactcaagcttattgacttctaaagcttaacatacaatatttttaaatgattcaagtctatacattttataggtctatagtttgagcaatagtagaagaatgtttaaagagccacttgttttccaattactgtattcatggctccaagataggcatgaatccccaccctaaaaacaaaacatgaaaaattggcatactttgagtagactacctctgtaaagtattaaaatctccaaacccaaagcgactctaagactcagtataattcatttattcgatggcactataatgggatttcttgcacagtgagaagcaagcaaatattatcttctttaagttcttaaatgttttatttagtatccctaaattaggaagggaaactaaacattcacataatcaaatatataggagggatctgtatattctgtattttttgaagttttttctactggcagatagcatctcattttgctgtgacgggcattaagactgtgattttgagatatggtcaaccaaaacttcatgcaactaattccatgcagatagcacctcattttgctgtgacgggcattaagactgtgattttgagatatggtcaaccaaaacttcatgcaactaattccagggtttatagcagaaaagaaattgttgtgtacctctcattacaactcttaactatttttaaggtagcttatatggttgacttagggaaaaggatgaagatccagaagaaaaatagtgagacttcaggtgatagagaaaaagagttacaaaatgttctaaaaggataaagcccaaaggctgtagagcaacacagtaatattaaatcctggattaaagtgaaatgatttaggagactttataagacatatctgcaaagcaatgcctttagaaatatttatttagtgagcctaattatgtaaaatactgagaattggtgacaaagtacaatattgtctcttcagatatatatttaacaaaattagggagttttgagttcgagcatttatcatcctactaaagcctttagcacatagttaattccatggcatgtattatcctgtcttccagagacaagtacaatgggattaaggaggatgaatggactgtctcacttagcctgggagattcaggtgaagtttgtgcacagacttgaaagaaatgcagaatttcctagggtaggcaggagatggggcttgcggtgagggaagtaaatttcagaaaaaatatcatgtgcaaaaaaggtacactggtatgagacagcatggtgtctttaaaaactgtagagcagtattccgatagcatttagtttaactccatcattatatttttaagctattttttgtactatacttctaaaacatgtttctatcctaagcgaacttacacaaacaccataacaaggcaaaatttggtgctaaagtataagccataacactacaaaggcaacgcatacaggagatttgatatgagtgttttgtacatatttcaattattagcacagggttagatataattcatcactcaaaactgattgttttacttgtacagaagccagtatgactgaagctctcttttcagtcaattaatgtccacttgcctgccagtttttaccatacatacctgtgccctccatgaagctaattccccaactgtttaggaaattcaaatggaactcctaaatagttcacacacagcttttgttaataaattacccaacatatttcaaccaggtcaggcttcacagctatacattttttaaaaagtgtaaattaactcttgacaagggaaattcaaaaccattcaaaggcaaagcctgtgaatgagacaaaggatgaaaggaaaatagatgaagtaatgcaatagccagctgaggaggaaaggatgccaagtagctgtgacacaacagcatgaagcaaagtgacttcattaatactctgcaaagtaccagaatgctgcacaagacaacacttcgtttccaaaccaaacacaaccagagtttaccactattgattttaagtagcagctgcctaattgctagaaagcagatacttgagcagttgttgagatatgcaaatgcaaataagcattgtcacaaatatatctgtatcacagcgagtatggcttttggtttagttagttacacaatgactgtgatatttagccatcagagtaattgaactttataaagtaatcagcagtagcaaacaggtatataaatagcagttacttagatgatagtcaaatcacaattaaaaaatatataaagaactttattactgtgcttttatttcctaattttaaaaacattttaatctattccaacaataatttactttaaaatgataatctttgtcacaagaatgtttattctatgaatatttactcagcatcttccatgttaagtgtttatgatgcaaaaaacaaaaattttcctacagttatttctgtgttgctgacgttaaaagaattcatagaataaacagcttagggaaaaatgataaatgtgtaatcacacaactccttagcatcgttaaatatgtatctgaagagaccatattatattattcaactccctcaaatttaacaatctaaaatagtgatatattttggctggtgaaaattttagacttgacattctactgtggattatcaatttcaaagaattacattgccaagaatatgctacaaataatgttcatgttatactgaacctaatctagttttgcctccacaagttcagaagatacttccaatcctttgtcagcaaaagcatccattttaattgagcattctgttccatttactgtatatttaagttgttgttattacatagcaggaactgtactaggagaaggagacagaaaggtggtgacatacttttcctttcatggggaaacagtctaatggagagaaggacaagtaagaaaccacaaagtgtattttggtaagtgttttgagaggagctcttgaggctcaaaggaggagttgttggttgggtcccctgagaaagcaggccttgaaataaggacttgaatagaattagtttatttgggaaatgattacagggaacagtagtagggagcgaggaagcaagacaggaaagagatagagtcaattaaaggtgcgttgtccagcaagttcccacctggctggctgaagcctaatccaactggggaagtttgggaaatggtgtaagacacagtctcaaatttatcacacctaagggagagggatttggagtatttataactgccagcagtccttggttgcagtctattcagaaaggtattaattctcttacgcttatgatttgcaaaggaaaagaaagtcctcagaccaaaacaataacagcaacaaccaaaaactgttttcgtttggaaggaggaccagaaggaaggaataagggtcaggcactgactctacaggtactcactgatctctttgttatgactatggagttttctttactttattcccacattttttcactgcactgggacctgcattttttttttctgttttgtcatttgtcacgtttgactttctacttttccttagttagatcgtgagaccaatcacagaaattatttatttatacattttcaaaatgtcttttcctctcctacccttcttcatgctatttcaaaaattacaccactggatacatttaaatgttcttcctgttttgcatctaaacccagcagtgaactatcactagagaaaaacacctgacttcagtgaacacctggtctcagataaattcatgaccacagacctcaagtaggtgctgagcacagccccgccatcctcttgctacccccatcctccactcccaaacttgactatttcataatggctccatggtcaaagtttgataaccatgcctcagctgatagtcttgcctcctatttcactgaggaaatggatgctgtcataaaacaaaatacttcattttatcactaacaattctacctaattatcattatctatgcccatgaactccattttccacctgttacaactgatgaactttattgctacggccaaaacttccaatgatacactggatctcatccctttttttgtcaactcaagaactttattcctacagttatccatctttcctaaaacatatatctctatatttgtaggattagtttcatcagcatttgaacatactctaggaagtaccacagtaatgtgagctttagtaattaaataccaaactaaatagcatttctaagcctcagttacttcatctatcataaagaataataaaatctacctttttggattattgttagcattaaataaaatgaagcataaaaagctcccaaaatatatgacattggttaatactttattattaatattctattacatagctaaatataacaaagctaaaatattgtcttctctcaagcatatcttgatttgtacattcattctggaacagatactcagactcaaagctcactggagagcagaatgagtattccaaaaatggccatcatatgtctggacccatattctcttctagaacattgcccctactccatcaagaagttgagtgtatgtacttctctctgaacctgggtaggtccttatgactttttgactttttcaactgatatggtatggcagaagcaaagctgtgtacatctaaggctaggcattaaaaggggatagtgcatccacctggtgctagtgctctctcgctctctctcttttctccctctctctgtctctttctctccttctcttaaaatgatcacccctggaaatgagccaagtaacccaggctacttggaccagcccatgttgaaagaacagaagttcccactctgtagtcatggctatgctttacagctgacagagcaccaccttgcctgctgtgtgagtgaaccatcttagaagcagatcctccagtgttcagatgactcacatcatctggtgttgtatagatatggcttttacataatgacacaaactcaatatttttaaaacatttattcatggagtaacactgccaacttggactgtgagagcagagacactaaaaaatgaaaaggggtctttagactccaaatttatacaagcaggaagcagactgagaaaactacttcatcaaacacatgttacatattatggaagaggaaggataattcagaagcagaaccaagaatttaaagaccagacccaagagccatggagctgacatgacaaagtgccacagactgggtgacttaaacaacagaacttgattttctcacagttttggaggctagaagtctgaagtcgaagtgtcagaagggttcgtttttcctatggcttgacttcttggcttatagattgctgtcttctccttacatcttcccagtggtctttcctgtgtgtgtgtctgtgcttaatttcttcttcttaaaagaatgccagtcatattggacaagagctacccatacaacctcattttaattaactctttaaacatcctactcctgatgaagagtaaactgaggctcaataaaaccttaaagagtttatttgagcaagcaacaattcatgagttcggtagctccaaaccagaagtggttcaagagctccaatgaggaaatgcaaggaggaggcttttataggatgaatacagagggaaagcaaagaaaatatttgattgagtacaattatacaattgccttctttggcctatcccattggaaagtctctagttttacaattataagtttatcggctacttctgattggttgagcttaagctctgcttttctttaatacaggcatttacaagaagtagctcaagttaagtttcactgatgtttgcaaatcaagcaaggtttaagtcatttatgaggcctcactggtttcatcttctcagagattttttaggccttgtctccattttaaggtattttaacactccaaatacagtcatattctaaggtacttgggattgggatttcagcatataaatttgtggggacacaatccaacccataacaccactgctttgggatttcttcttacatggtaatagataatccaaacatcccctgtttcctgataatatcctaaattgtttacacagcacttctggaagtgtcctttctcattcacttttgaaccatttaaggactaggactttactttgtgtttctgtagtcttcatgcatagcacaaatttcacaatcaaagcagccctggcacataataggtcttcaataaatgtttcatgattaaattcctcaaaggccgcatcatgctctctaaatgttttttcaatgtgcatctcttagaatggtctactgtcatctattctgtgatggaagaggcagtgtcactttttttggctaataattgtcaactcagcattcaaagccctgcaatttgactccagtctatctttcttgcctcattttccacttccccttaccacttgcactacacttcaacccgtcttggccataagctctttcttcatcatgttccacattttttccattgttggctatgaataagtgggcaaatgtgcagaggtctacttccttttggatatttttcttgattcctcctaaccatctaagataattgttgtttctggtaaacgcttttacaccattttgtactttggcactcaccttattctatcatgtaattcattcatatgtaaactccttctaccttagttctcagattgtaagctgctgtaaggagtgcttcatgttcatatttacactccctgaagtcctcagaagaacatctgtagcttagtagatcctcaagtatatgttaaactgccttaaattgattaaaaactaacttaagtcatctccccttatggatattaagtatattgactttaaagggttttcttgctgctacaagtcataacagtaaatagatgtagagagaaatgtttacaaggactataattaagcaaaataggctttctctgacttttgcaagcaaactaatttgtgtgtatatcatttagaattgattaaaattttaaatttaatatctgaaattatttgattattttggttcttgtgttatagttatttcttctgatatctgatctgctatgatgatgtaggataatctcttccaacttgatttacaaaacttgttttcaattgctgtaccactcacttcctcaaaggttgcctctcatatctcctcatcatatatacctcttcaaattcaatcgagatttcaattcttctcacttctccccaacctgtgagtaccactttgttgcactgtaaaaatgcataagaactccttcacattatttgaattttgcaatatattatgtattctcagaaaaagcactacattgacacccatagtgttgaactacataattttaaaaagagctgatttgagtacaaaataattatttaactgactacttaatatctaagtatatctttcacttaaaacaactgatagaatttctttgaccaacaccagcatctcatgtgacttagtaaaaacatttgtatatttagatactggcaacagaaaaatggcttggagatttctcagcaaaactattctgtttcagaaatgttttgtttcatattttattagtatataattataatactctaaatgtcagttacaaaaattaaatgaatagttgtgtttttgaatatttaccacctcttggtgttctgctcaataatgtacagtgtgactaagtatagtaactctatgagtgactatacagaatttcatacccttctcctcaaagagtggttaaaatacttggagaacatctccattctttaatagatgttagaaaaaatcactttaaaaagtcctttagatttaataatttaaaaaacgggaactcctttttagcaaaaatttgattataagggttttttaagtttccactattattgaatgtcagttaattcttaattcattcttctgtatcttctgaaaaatgtggcagtgaaaaaaatttcaatcaaccacaattacatgtctaccaacccaataatcattaagttaattaacctttaaattcaagaatcaactaaaaggaaatgttcattgaaatcagtttttaaacaaaattaaaagtaagattccaagccaatattttttggttaaagtttttagctttcaaattcagatgataaagcaaactaaatgaataaactatgtctttcagtagctataaccctagttcatatagtaggaaattattgtcatgctacatgatcaagtcaactaaagtgcctaggaacataggagttatttagtcagtccgatctagaccgttttgttaagttccagaaagtatagaatttacttaattggcaccctgataaatggttctccaatctaattggtataattaccaaaaggcaggtacagtgtaatgtatttaaatgactcaaatcaataggttcatggaatatctttttcatttaaagagagttattaacttattcaatgtagtctactacatatcaatatctagctccaaatatattctagtataccttgtctccagatctatgattaagaaagagattataagtgctttctatggttttcatctatctggaacaaaattgaaaacttagcaaagggagattcttttcaactaaaatttatcagagctgcgctgaatatactttcttgtttaccaagaactgtgtgatgatacttaaataaatgattatttccatcacctatcaaaatgttcgaagccttgattttcatctgtcctattatagtccatctattgtcttctctgatgcacagtatcatgaagaaaaagttaagaattattatgaaggaagtgtcttcttcccttcagcaggaaagatgaatgttttactcatgaaagttatgaggtagaaaaatagctattccattttgtttttcacttttgatatgatataaatttcagtggagaccttagagattcataagaaagaaaatgaaaaacaaagtcctcaaaaatacttttttttttgtcagaagagcatcattatttttaagtttctcacaaacttgtttgttctgtctccagtactttgatctcctggtaattttagagtaattgagaatattttctaacatacgtgtcaacataatgaaggagctgggacctaaatgaagaagcgacagaatttacagtggctttgaatgctggttcctgaatggatttgcttgactgcaattcaatcttttttgtggctcaaggctcactcacctctaaaaggtactttgtcagaatcgatttaaatcaatttctgtggaaattaaaattaaatatggtatccctaagattcttgcatttatttcaatttttaaattattgatttatacatgatttttatgcccctatcattatatgaacatttatataattagtgctgataaccaatatgcaatttcatttctttctctgagatagctttcattacatttacttttcacttcagaatctggcattccagtcttcttgaagcttaattcttttattgaaatttagttatagatatcccatgatattctctccctggaagttggtattataagcttgttattgtttgtttaaagttggctatagaaggatattcttccccagtttgtctttagaggttagagcttatcaatttttttttttaagaaatttggggaggttgtttcacttgtgatcgtcaaaagttctgagtttcttttgttgttgttgttgtttttgtttttgtttgtttgtttgtttttgagacagtctcgttctgtcgaccaggctggagtgcagtggcacgatctcggctcactgtaacctccacctcccgggctcaagcaattctcctgcctcagcctcctgagtagctgggattccaggtgtgtgcaagttctgagttctttaaagctttttaaaaaggattttctaaatgtttttctcttaggagatttagaaattttatctatatttcattgcattgcaattacatctgtgtcctgaaacattggttattcttccgggttttgatggttactagatgagtgtgtgtgtgtgtgtgtgtgtgtgtgtgtgtgtgtgtgtgtgtgttatgaacaatgctagattattggggaaaatcagaataatttgaatgccatcacactatccacaggaaaggcatatttgtttatacaaaattgtcacaaagagaaacgagaaaatcttttgtgatcatgcaggaccagaaagtgataaaaatatatggttctgtagaaataaatgtttagctggaaagaaattggcagttttcttctttgtatttgctaccaaatttcttcaaccttaaagttttacaaaattgttgatacacaggaagaaatgagaaaagagaatataggagaatttattttagccagtgagaaattttagaatttggtggatataatgtataatataactataaattcaaaactgtacttgtctgtgatatcattagtagaatcttttagaaatcaggattttaaaaatattaatatttgtaaaattaacattgacacttaatacaaaacatacattaccttgttatgttgctgcatatccagagtgtaaactaatgatgaaaatcataataatgatcacaatcatgctaacagaaaataacatttgttgggttcttactctttaacatattacctaccgtttctcattgagttttgtggagatagtatgctcaatgattttactagataagaaaacattacatcacatatctcatacaatttcttactgttaaaattaagtatgatgactaaagtaattataaaattctgttctcaaatgcacattattcacacacacaatatttcttttgtttgtttgtttgtttttgtttttgtttttgttttgcgacagagtcttgctctgtctcccaggctggagtgcagtggcctgatctcagctcacaacaacctctgcctcccgggttcaagcaattctcctgcctcagcctcccgagtagctgggactacaggcgtctgccaccatgcctggctaatttttgtatttttagtagagacggggtttcaccatattggccaggctggtctcgaactcctgaccttctgatccgcccgccttggcctcccaaagtgctgggattacaggcgtgagccaccacgcccagcccacacaatatttcttaaaatgttatggatttatattttatctttttaaatccaccattaaggtaaatgtattcaccagacccttagggtttcagcaaagaacgtgaacttttctcaattcatttgtttattcactggtaatatttcatattgaaattgagaagacgagagaattatgataaaagtcgcttttgtccagtcaatgctattaagcgagttaaccatagacattctctcaaatcagctaatagaattgtattttcagtggatatttttaattgcattaaatacaaaagatataaactaaattattcatcctaattatacaaaaaagatgataaacttaagcaatatgactatctgtataattcactcagaaattaagattttcaaatcaccaacagtttagatcaaaacaaaaggtataaataaaaggcctctaacggtatcaactacctcctaaatttcaataacagaatcttttatgaaatttaaattaatacggcattattgaatatacacgaagcagaataatccttaaatatatttgtgccgatctggttttggagaaagttttaaactttatgaagtcctaatatataaattgtttttatattatggaatacttacaaatatctaatgagctatcttggcgacgagacctaagtctaaacataaaatttatttatgtttcatgtatgtcttatgtacatcacctgaaggtaattttatacaatattttaaataaatttgttcatgaaacaaagttttgatggcattttattatgacctgtcaccgaagatcaagtaagaaattttccgatggcatgtaggtgctcaattttagattttagagtattctggattgggggcattcctaatccaaaaatctgaaatccaaagtgctacaaaatttgaaactatacacaccaatacacaatacacacacatatatatatttagtttcctgacatgtgtgcctgtatatgtgtgtgttgcttttacagaccatgtctttgtgttggacatgtcagtttaatatgcctgccatatcccaattccatttaacataatttgtcttcttcgaactcttaaaagagatatgcaacataccagctgacctcacatgaatggttatagatacaggcatgcctcattttattattattttatttattgcactttgcagatatcacttttttttttttaacaaattgaaggtctgtggcaatcctgcatccagcaagttattggcattgttttccaacagcatgtgctcacttcttgtgtttgtgtctcattttggtaattatcacaatatttcaaacttttaaattattacgttatggtagtctttgatggtggtctgtgatcattgatctttgatattactattgtaattgttttggagtgcctgccatgagccacacccatgtggatttaataaatgttgtgtgcattccaactactttgccaactgctctctcatctctctcactctccttgggcttctctatttcctgagaaaaattgaaattaggccaattaataaccctataatagcctctaagtcatgggtgttcaatcttttggcttccttaggtcacattggaagaagaattgtcttgggccacacataaaatatactatcactaatgatagctgttaagctaaaaaacaaaatcagaaaaaaactcataatgttttaagaaagtttacgaaatttgtgttggtcaacgcatatcctgggctgcaggctgagcgttgaacaagcttgttgcaagtgtccaagtgaaaggaagagttgcatatctccctctcactttaaattgaaatctcaaaatgattaagcttagtgaggaagggatattgaaagctgagaaaggcagaatgctagtccttttgcatcaagcagttaaccaagttgtgaatgcaaaggaaaagttcttgaagtaaattaaaagtgctaccccagtgaacacaccaatgataataaaatgaaacaactgtattactgatatagaaaacattttagtggtctggataaaagatcgaaacagccacaatagtctcttaagccaaactcaaatccagagcaagaccctaactgtcttcaattctgtgaaggctgacagaggtgaggaagctgcagaagaaaagttggaagctagaggaggttggctcatgaggtttaagaagctatctctataacataaaagtctaagatgaagcagcaagtgctgatgcaaaagctgcagcaaatgatccagaagatctagctaagatcatcgaagaaagtgcctacagtgaagaacagattttcagtgcagaaaaacagccttctgttggaagaagatagcatctaacactttcatagctagaaagcagaagtcaatgtctggcttttaaagcctcaaaggacaatctgagtcccttgttaggggctaatgcagctggcaacttgatgttgaagccaatggtcatttatcattccaaaacttctaggacccttaagagttatgctaaatctactctgcttgtgctgtataaaatggaataacaaagccttgatggcaacacttctatttacagcatggtatgctgaatattttatgccctatattgagacctacccttcagacaaaaatattctcttaaaaaatattactgctctttaacaatgaacctaatcacccaagagctctgatggacacatacaaggaaatcaatgttgcattcatgcctgctaacaaaacatccattctacagcacatagatcaaggagtaatgtttgctttgtagtcttattatttaagaaatattttaaggctatagggctatagctgctatagatagtgattactttgatggatctgggcaaagtaaattgaaaatcttctggaaataattcaccattctagatgccattagtgatttctgggaagaagtcaaaatatcaacatttgtagaagtttggaagaagtcgattccagccctcatggataattttgagggattcaagacttcagtggaagtccctgaagatgtggtggaaatagcaagatgaattagaatcagatgtaaagaattagaattaaaattagaattagatatcatgcctgaagatgtgactgaatcactgcagtcttctgataaaacgaacagatgaggaattccttcttatggctgaacaaagaaagtgattgatttcttgagatggattctactcctagtgaagatactgtgaacatgttttgaaataaaaacaaattatttaaaatatttcaaaaacttagtagataaagcagtggcagagtttgagaggatttactccagttttgaaagaagatctaccatgggtaagatgctataaaaggaaatagcatgctacagagaaatctttcatgaaagaaagagtcaatagatgtgacaaacttcatttgttgtcttatttcaagaacttggcatagccatcccaatcttcagcaaccaccattctgattagtcaacggccatcaacatggaggcaagaccctccacaagcaaaaaaattacatctaattgaaggcttaaatgattgttagcactttttaacaataaagtatttttaattaaggtttgtacattgtcttttagacataatgctagtgcacacttaatggattacagtaagtgtaaacataaattttttatcaactgggaaaccaaaaaatcatctgacttacctttctgcaatatttgcattatttgggggtccggaattaagcctgcagtatttcagatgaatgcctataattagactggagtgtatatttgattctaggagatccaatcaatagtcaatcagttttttctttatcagaaataagaggcagagaaactgtattctgaaggcaacaggttctgcgttggacaagttatgtaaaagttttggcctgagctgacaacattgcaaattattacaacctcctaaatgatgaataaacagaaagggtgggcagggaaaattcagttgtagactaaaagagtggaacagactctaagaagcaagaaacctgcaggatcagaaagatgtgaagctaaagtacttgttttaagatgccttggatcctatgagtccacatttccttttcaaatcttttaaaattttcaaaagaagacatttatgcagccaaaaaacacatgaaaaaatgcccaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaattaccatttgacccagccatcccattactgggtatgtacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacaccgcttattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcaccagcatggcacatgtatacatatgtaactaacatgcacattgtgcacatgtaccctaaaacttaaagtataataataataaataaaataaaataaaataaaaattcacccagcctgtttttcttggaatattttgagtgggcatttattctttacaactaaaatgattttcttttttggcttttctttcattagataagtgtatacatcttggaaaaaaattagcatatcaggacaaagttacatttatacaattatatttcattatttttcactaaaaacatatgttactataaagcaggtagcagagtttatcttggaaaagaaaggcaatacaatgatggtctttaaatgtggatggagaggctccaaggcatgccaatgtgtcctacggcatgacacagctgctggaggaggcagaggtgagggtaagaaacaatgtaaaatattataagggaggtgactcaaaccacatggagtatgtgcacatgtgtgtaaacatggatagaacttatgtttctaacaaagtgattcattttctgaagtcagggactgttttattctcttgtacttctcaatgtcttgaatagcaataagtccatagaaggagccaaataaataagtgaatctgagttttgccttcctcaatgaccttgggcaaactgtttaatcttgattacaacacaaatattttttatagctataataaactatagctgtgttgtgattggaatagatgaatgaatgaatgaatgttttttcagaacctgttagtaccagcatattagcaaggttagcaaacaatcctaagccctccaaatctagggctttctcactcccctatccccgcaaaaagatggatttcttactcacctcacatgatagctgcaaataactgctggtctgctccatgtattttctccatcatggaatccagcctgaaggtgaagctcctgtctcccacattgctgatctggtggcagagggaaaggagcaattgaataacaacgtgattatgctttaagttgctgctcagcaatgtcataagttatttctactaacacgtacattgaccaaagtcagtcacctgactcaatgggatgaacttacaaaccactcacagaaactaatactgcaaataacatggcaatgagaagtaggatatggaaagacccaagacatttctggattaggtattgttccctgaaagcaaaacatcttcagttctttatttgtcatggatcttggaactgacgtctacaaagaccttctttttccattctcttcctcggccatatctgaagaggttattaaaggatatgcccttcttggtggctcagatggctttgcagcctattttctgcctgtaaaagtttggatctccatatggggttataagataaaatatagtgttcactgttaaatttgaattttgataaactacaaataatattttagcataagtatgtcctaaatattgcatgagatataattatactaaaaatattatttgttatttatttgaaattcaaagttaattaggcattctgtatttttatttattactctggacaccttagtactcaaagggaatttcaagtctcaaataattatagtctgtttaatttagagtgctggcacaactctctcaaaagcatagtaagatttttatttatttgataccagtttccagtgccaatgtacacactttttccccctaaaataggcctttctctctagttttagctgccagtcatttaaacttagcaagattctatgggaaggtcttactctgagtctccttttgagtaattttgaccaattggaaagattgaatgggtgccacattagttatttctgagttttaataataggctttagcttccttaacacccaatttggtctttgtcttgaggctgagtgttaacgagcctttgtcactaaaatttcacaatgttacgttttactgacagaaatgtaaaggaattacacctcttgtctctgttagtaaactggccaattctttcttttctcatcttgttcttcaagtaccttatcaaatgctgccaacattacatgagtagctttctgttttccaacgtctccacgtacagctcaagctcatacaatacattgcctgtcttctaagtaattacaagcaacaatgatattaaatgttccgcttatacatatgcataatgagttgtcttgcatcccatcaacaataaataccctcttagacaactaccccgttcaaaagccaatggcacatatactggtgttctgtttcagcagaacacagcttacatgttccattttattaattagttaattttgctaggttacactgtactctgacaaaatcttagtggcttactacaactaagggttgtcttactccagatctcagcagaaaggctttcaatttttccctgttcagtatgatgctaactgtgtgtttgtcatctatggccgttgttattttaaggtatgccccttctatacccagtttattgaagggttttaatataaagggaggttgaattttcttgaatgctttttcagcatgtattgaaatgatcatatggattttgttcttggttctgttaacgtgatgtatcatcttcattgatttgtgtatgttggactcattgcacccttgtgataaagcccatttgatcatggtgaaaatctgttgttgcattcagtttgctagtattttgtggaagatttttgcatttatatttttcagtgatattggcttatagtttttgtccttgttgtgtccttgtctagttttgataagtgagtaatgttggcttcatataacaagtttgaaagtatttcctgctgttcgattttgattttgaagaatttgaataaattattattagcttttctttaaatgcttggtagaattcagccatgaaaccatcgggtcttgagcttttctttggtgggagacttgttttatggcttcagtcctttacttgctattggtttatttaggttttctagttcttcatggttcaatcttggtagttgcatgtatccaggaaattaaccatttcttctaggctttccaatttgttgacttatagttgttcataatagtctctagcgattctttgtgctttcagctgttatgtctcctttttcatttctgattttattgggtcttttcactttttttcttagtctagctagagattcgttgattttgtttgtcttttcacaaaaaacaattattaggtgttagtaaagcaacttacttgtatggagaaattttatgtcggagaataacaagagctattatatgtgaaggtaaataataaaaattatttaaagatttcttgtaaatttagacttttttctgcagaatacgtggaggcaagtagtgtcttcatgaaaccaggctcttaagatactgaaatagtatcaacgtgttgagtattaaaaagtgacacaattgagtggtactatgccacttcagtgtactgaggaagtaaatgttaactttgcaattgctatatactgtaaaaaaagaaagaaagaaagaaagaagacaactagaagattattatatagttggcacgtgtcttaagtcctacctgagattagaaagtttcattgaatttttctggctaaaaaaattaaattaaatcaattataaaagtattctacttacacttgtcattttagcatcaatggaattagaaaaaaaaagtacagtgactgaaaaaaatcttgcaaaataaagctaatatttaaaaaaattttgattccttgaaacctcctcaaattacgactttgtgccacctcattgcgagtcattaatcaatgcacacttaaccaagaaaataaactaaaaattaattttgtgcattgaaaaaaatccaaatcgacttgtcagtaagagaactaaactcaattctaaatcgcatgtgtgaaaacaaagagaggcatgaaattttagggtctgtcacattagctgaagatgtcttaacatgaatgtgccactgttgttaaatgagagcaggaaaaggaactaggagttttcaaatatcaatgtccattgcttttcagaaacagcatgtacagactgggtttacttgtgctatgtccatcaagatactcaagttactagaatcttacattttggagtctcacttatagaaggaccttgccctgaaagaaaggtgaggggaaataacttcagattaaggtgcaggagacctgagctataattcctgctctgccacttatcatgtctaggtcttctggtaagacttaatttacctctgtctcagtgttctctgacaggagggagttcgacttagttcaaaaatcacaaaacaacgatggagatttcaccactttcttctttttacattggattaaataaactattatctaaagatttggggtcttcatatttcacacagaaatatatattgagtagcaaaatcttaaaagagtattaaacatcttctaaaacatgacactgtgaaatatcccagagaaactttaattatatgattatctaaatacttgatggtctagagtctctattaaattgattaaatttaatgattaaattttaaataccctcaaatattagccacacaacaaaaagagcacttgagtagttgtttcctacattcagctctgaaatatgccaaatctgtgtttataaacacagcatcacagaaatggacctgcagttgaggatatgaactggaaagaccaaaatttaacaggtaatcctagcctaatttgttgagtgctcactatgttctaggcactattcacatttcacattaattaacttatttaattttctacaaactttcacatagggtatatttgtgattctcattaagtctgacaggcactgttgatctgagttaagtctctaattctgggcatccaaggcctctgtcctctctttcttcatctcttattgttttcaagatgagatgaattaaaattcttatttgttatgcatttggcataccaccactcttcctgctcatctgtgcttataagattttaccctgcttgcataagtgttcatgagccctcaattttgaacagctgtgaggaaggctggttaactatttgtaaacaccacccaatgatgcttgacagtgatggcagtcttgcagaatactgaagtgctattttactgggagtgataatgagactgtcttgtccagaggtctggttattacaccaatactaaacattatcatttagttgtctggtgtaaaataatgaattagtcccatatattttatgaggctatatccacatttttttcataacagaaaaaaatggtatatacagctatgagttttattgatataattcaaatttacaccattactgagttttctaattatctgccttggttagctttcagaacaaatacagaatttatattgtgaattactccttcttttactaaaaaaaaagtctttttatcgagttgttggcatgacgtgattactaactagtagttatatatatatatttatatatatataaaactactcatatatatgcatatatatatacatatgagattatttgaagtagaaagtaggttttctaggaaaaaataaaaaataaaaccaaagaaaaatagagttaataacctttacaagagtaatatgatatttaattatataaatgacatactattcatatgttttatgtcatacagtattaatgtatattatacataataatacatttttctaaagacccaaatatttttcctatatggtccataagcttagaaataacaattgcttttattatatcaaattacaagctagctctaagaagtcactcttactaattagggttgaataacgaagacaattacaattgaaaaagggcatggcttctaatgagagatcagtaaatagttgttgaataaatgtataaaaagttatgaaagcttccactttttttctaagagcatgtagcttgttaagttgcaaagatgcaaatgaaagctgtgtttctcattgcaattcaagacctgtgctgctcccatttttatgcatgtagctttatatacctaaatctttttttatgttactaatatcattttgtagatttctatgtaaagtttgtgcacacttttcataaagtatgcacattactaaagtatttataaagttgttgctgatatgaatgagacttatttttcaattttattctccaactggttatggtaggaatgaaaataatatcatttatattaaattctcttatttattctaaagtgttttgagtacctactatgtgcaaggaactatgctaggaattgggataagtgggaaaaatacaaagaatctgtcttcaaggagcttttggcctacatgggccaataaccctgtcttgagtgagggcagaatggaagaattgtaattgagactgttgagacaattatcctgtggcattcttgcacctctctatatctcgatagcagaggtactgactgcctttgtcccaactatcttttcaatgatatttgtacagtgaatagacttggaagatatagtatctcagtccagagcgaagacaggcttgcttatagtcttagaagtataacctctctcttggcagcaaaaggtagacatgcttattattcattataaaagttgggctccctaagctcaaggtttctctcctgaaatgcaacaggtatgcaggtgtcactttaaccctcttggcatcaccctatgggaacagagggtcagagaatcagagaaaatactaaaactctgctactgctattgccatgattaataaatttttttccctgacccaggaatgtcccatcttctgccagcatctataaaactattgaagcctaacttgttagcttgcaagtagagtaaactatcaaactttttaaagtttttgacatggatctaaagtcaaagtaggacataaccaagccaaagcaggccaggggtaaggacttcataaagagcattgtaaaaaaaggccatcacatttattggcctggtttgttcagcatcacagaaatggaactgcagttgaggatatgaactggaaagaccaaaatttaacaggtaatcctagcctaatttgttgagtgctcactatgttctaggcactattcacatttcacattaattaacttatttaattttctacaaactttcacataggatatatttgtgattctcattttatacccgaagaaacaaaggcaaagaaaagataagttacttgtccacagtcacatatttagttagaagtagaatcagaattcaaactcaagatgcatgactctagagtccctggctcttgaccttagactttatatctcaagatggacttgaatcgaggccatatcataaaagtcttgtaaagcacacttaggacgatagacttcatgctaggaaaatgtgtgctataatttggatgtttgcccctccaaatctcatgttgcaatttgatccccagcgttggaggtggagacgtaaaggggagtgtttggatcatgggggtggatccctcatgaatggcttggtgagttcttgctctattagttccgacaagagctgattatgaaaaagagcctggcacatccccactgtctctctcttgcttcctctctctccatatgatttctgcacaggtctgcttccctttgccttccacaatcagtggaagcagcctgaagccttcactagaagcagatgctggtgccatgcttcttgttcagcctgcaaaacaatgagccaaataaatctcctttctttatgtattacccagcctcaggtcttcctttatagcaacacaaatgtacaaagacaataggtaaccaccaagaggcagggaaatgacctgacagtggtaaactttgtactctggaaaaggacaaatatcagaggcagtgtagaagctgctgcagtagtctaggttacagacaatgatcacaagaagttaaaaagacaatttgggatcccttttataagctttttttttttttttttaaatctgtagcaccaagaacaatgtatagtagcaatatgtactcagctgatacatttcaaatcaataaattaatctggtcaccatcttaaaacctctaattctaataatatgagtgtgcatttggtaaaatgtatacaaatgtgtaagcatatgtgcacaagtatgtttgtaaaaattttaagacgcaagtaatggcaaaactgaaagacatttcattcaattttctctgatgttgagctttgcagttggcataatgctaaacccccttaacttgaaatctcatgaaatgctgttttataagcagtgatgttggtccttggatataaccacatgtcctgctgcagcctggatcttgcatcaggcaattccacaacttgaactgggtaatttttgtcaaaccatggttagttaacttgggcctttttcttaaactggagcttgcattggcaatctagatttcctgtttttttgcagccataacatgcaacggtgaaagaagcaaaagtctggtcagaggaaaaaccaaaagtccggtcagactctttaagagtaataggactctaagttctgaccagattttggtttttcctcttatgaaatacaactaaataaaaagttttcttagattaagataagacatcaagtttctgatttacagcagatagaacctcagagaaaaggatgcttcacatgacactggactgcatttgcattacactgattattttgagagaactgaaataaaaatgatgtatttaatcaattaaaattttattttaattaattttaatttagttagataatttcatttaattgatacattcaattaatatataatttaattaatatttttacttaattaaaatgtaattattttaaaatatgtaacatatttctgtatcactagcctcttagagaaggccatattttacacatatgtgaaaagttctttgaaggagaaattcaatatcattatccatattatttatgtgttttgggaagggtcaggacaaggcactagggttgacatcattatccattgcggtggtcacttgactttccttatttaattttatttaaattaaaaatattggttggatgcagtggctcacacctgtgatcccaacactttgagatgccaaagggggcagatggctttgagctcaggagttcaagaccagcctgggcaacatggtgaaaccctgtctctaaaaaaaacacaaatattagtcagacatggtggctcatgcctgtggtcccagctactcaggagtctgaggtcagaggatcccttgaacctgggaagcagaggttgcagtgagccaagattgtgccactgcactccagcccgggtgacagagtaagactctgtcaaaaataaaataaaataaaataaataaaatggaataatctttgaattctaacctagactcttaccaggtggaaaaacttatctggaatgaaaataaaattaactgagaattacctctgtgttaggcattatcctcggcattgttgattatttcactatacctgaaaaatattacaagtcaggcatttttttcctcagtattattttaaggtggaatttagaaagaaatgacaactaataagtcaaaaaaactgaatgttggcaataagttcatatgactccattgaacaaaattgttcattctgtttgaagttatacattaatcaatttttaaattataatgccttttatatttttgcctttacaataagtaatattctagttttctttattatatttttgtcaaacaaaatcaaaaagtaaaattttaaaaatgagaatactttgtttgattctatgtaaataaatatgacaacctaaagaaaatatgcaactttttagagtaaattaattacaaaaatgaagaaaacattgaaaactaaacaaaaaaatcatatataaaattaataaacatggcagagtaacactcggatagtgaggtaatgaaggttttaagttaaatgtttaaaccttcagaacttaaaccaaccagttgtgctaattctatttacattattaaagagaactaagaaattcaatgcttgccaacatcttttataaaagcagtagaacattgataccaatacctgccaaaggcaggttgacaaaaaaatctttcaagctaatttttgtatgttaatacacaatccaaaataaaattatattttaatgaactattagaataatctacaaatatttgaaaataatataccctataaacagtttataagtggaatgcaaagatggttcaatattagaaatttaatgtaattagttatgtcaataagttaaagtgaaaaatatgtatttttcataatacggtattagttaagataaaagttaaactgcaagactttaaagtaacaccagactaggatgcaagatgaacaaattagttaaaatagtgtgcactgaaaacaaaaatattccatgtgttactgattttgaaaaatttcaaagtactagagaacagaaataaaaatacatcttgaataactatgacctttcgtctagaaaagattgataacataagaggcttttgtttttgttttgttttatccataaataatttgttatgacacattatcttgaggaattacagaaacattagcataaaagagtttaagtctacaaattaaaaaattaaattctacaagttattttccatgtatgtcttagaagaactgcacaaaggagtaccagatttatttaataagtaaatagaaataagccaatataaattctagaaagaatattatagctgacatatatatatatatatatatatatatatatatatatatatatatatatttttttttttttttttttttttttttttttttttgagacagactctcactctgtcacccaggctagagtgtggtggcatgatctctgctcactgcaacctccaccccttgggttcaaccgattctctggcctcagcctcccgagtagctgggattacaggtgcctgcaccacgcctggctaatttttgtatttttagtagggacagagtttcaccatcttggccaggctggtcttgaactcctgacctcatgatccaccagccttagcctcccaaagtgctaggattacaggcatgtaccactgtgcccggccaacatttatatatttttacctgacactctttctcttaaaaagagagacagagagagaaaggaagaaggaaagaaaatctcacttccaaccctgattcatatgaaaaatgactccatacttatagtatcccatttcttccccttccaaccctgattcatatgaagcatgactccatatttatactaccccatttttccccttggccaaaggttaaatgaaagatgggctcaagatccaagttatgactattaatgtttcctctttagtaaattgacagagtacagtggtattccagtcccagttaaagctggattcttgaagaggaaatggaagtgtaaaaactggagagcctcaacacacctttcatatttttcattttgtacactagaatgtagagaaagctggtctgtgaagagaaacactgatagagatgaaaagaaaacagccatataatgacatggagagtaagataggaaacgaaaatgaggttttccacagtagggtgagccctggctccagacaattgtgagctaaaatgcaatttctcacttggtttgtgaaatatcccagaatccttatatttaatattacattgtggtctcagaaatgggtgtaatatttttcaaagtttaaattatatattttatcatcactttaaattataatatttttgactttcattcattcaatcctagggtttccgtgattctggagaaattctgaaataatctgaacaaagttgccaagtgtttgtggtaaatcagggtttggtgtcccaataaaacaatagatttgaaatccagacttaaataaaagacaaaagaatttacaaattccaaattttcttacaagttaaaacattttggagatctgaattttatgttttattatgtagaatataggtggaaagaaagcaactacaggctattccagagaaaacacatatgtgagtctgtagactgaacagggtaggagagagagagagacaggggaaaataaaaaagtaggaggcaagataccagtgtctttagttctccatttcatctcaatctggttcactataggataagcctcaagatgaagattgagcagtgatggaaagccccaagagagggatggaggtgggggtggctaaaagaaaaggaggctggggccctacaacctattgggacttgaggaggccacttggctgaatatcccacaacaatagtaagcaaccgcagctgagtaatgatggctaaatgttcgtagatagtcctccaccctactctcacctttgattccacacattctaaacctaatgagggaactgtctcaaaagtcactgtgtgcccacaatggggaagagagaaaccactgggtaattaggaaggggtcagatgaatatcatgatggagcttcagcagaacagcagtggcaggggaagctgaagtggagccatgtcagaacagtgtaacctgtttgtacaaggaaaaggacctgcaggcactcactgtgcagaaaaaaaaaacaaaataaaacataaacatgactttcatctgtcatagatgtcagaagtagatgagcaacaaccaagtgggacaaaggacatcctaggggacaccactactcaaatttgagattttctgatgcctcatgctatgtccaggtaccatcttggctaggagaaagggaaaaacaaaccattttaaaatgaaagagatgagttacctttaaatgacaaatttaaaataccatctatcctggctcctcccaccaccattaaagagaatccaagtttcagaaaattagataaaaagaatatgacttttttcaggtataagttcagcatatgtgaaatttaaccacttaccctacagtagtaacacatgatttctcttaaggccaaagttctaagaaatgccagcactgagcagagaaagaggaggctgtttctgttgatcccaaccctatatcagaagggatattgtcgtggctatgataactagtagcaagacagcggccatccctacacttctgttatgtggcagcatgatcattattacataattaaattgtttatgttttacacatctgttttgttctatgacagattatcacaaatactctttggttatccttggttaaagaccattagtatttaatcaaataagtttagtgtagataattcttacttttaagcaatttgttgaattaaatcattatgaagatcagaattccaatttggacatttgttttctaccttcagttatgattttatagtgtagttgtggggagtgtcttcaagggaaagaaataacataagttcagtaaattcaggtcaatggtttatattgaactcaactggtagtaatgaaaaaaaatatccttccaactcatggccttcctatgagcacatgtgaaataagttgcttgcctagtgaaaatctcaaggtgactgaaaacatgcacatcacaatatactccagtgtgcatgttctaggacatgtgttaggtagtcttggtgaataagcaaggtaacacagtattcttaagcactcctccaccattcaagaaaagatgagtgcagagctagggggcagtcatgggtcagtgtcaatgaaaagtgaagaaagtgaggacctgaactttctattctgcaggtcagttaggtcttgctgagtcagttaagacccggctagtcatcaacatctcagagcaaggtctgctcagcaggactttgcagactctgcaagtccttaagaaatgggttctgaaatgtccaataatagccactgtaattaaagcaactcctactcttaagatgcttggggtattttgataaattgagaagtctctaaatcaattatctgtgcaagatctctgaatgttcaaatagcaatttagattgttttaaaaatctgctttgagtgtctgtgctgggccaaatctgatgttgatcccataaattgccttcttccccttcaaaaaaatcacacctaaaaagaaagcgctggaacagtctctttcgaaagtgatttcattatatcttggctattaatgatggttacagtgtgtgagatattaaatcatgaccctgtaagattctggaacttttcctcagccagaatgtcattttattttaattctttaaggttgcacatttttttatcctaatgtaggatttggtggactgtaattaaacgatggtcgatggacctaaattttatgagcaattagatatactgtatttgctttttttacccctctactgagaatatatgctggctttgtggaatcactaagatgtatccctctgcccccacttgctttttagttcctgctcagtgcaaagaacacacagaattctgcaatgattttgttctattattgcttgaaatatctacttcacattccactggagaaatttaatgaatacaggaatgtaaagtaccatttaagcattttttctatgttctcttcaccttttatgtttctttcactgtataaactccgtcctcttcctgaaattccactccttttaactgacacacaaagctgaaaatgggcaggtttcaaaagcctagaacatcttatactcatgcaagaatataagagacttattgtgacataactttttttttttgagaaggagtctctgtcgcccaggctggagtgcagtggcgcgacctctgctcactgcaagctccgcctcccgggttcacgccattctcctgcctcagcctcccgagtagctgggactacaggcgcccgccaccacgcccagcttatgttttgtattttttagtagacacggggtttcaccgtgttagccaggctggtctcgatctcctgaactcgtgatccgcccgcctcggcctcccaaagtgctgggattacaggcgtgagccaccgcacccggcctattatgacataactctttagatacattcaatattttttaaaattagaaaacaaacccaaatcagaattcaggattcaaaataacaaggaaatttgcattgacagatataagctactgtcacaacagggccaagtatcttttctccaaattatttatttttagtcattttctttaaaacatttactcatatgattgttgtattatggtacctatgtcctcttgggaataggcattgatgagacttattaaatattatttcatcaataattatgtggcttccatacctgatgatggacacagctggaagatcattttcatcattatacttcttttcaaattattttttataatttaaaaaattataaataaacattgctgctgtgctgtgatcccaaagggcattatgaaaaatagatacacacacaaatataagcacatatccaattttacatattatatattattactaagggaagggaatatatattatatattgctaagggacgggaatacatattatatattgctaagcctctgaggctcctaccactcttgattcccatagcaacatagttgttggatcagtcaaaaccccacagagacatgcaaaagttcacatcttttatgctggacctcctcaggatactctaatttgctacagctgtgcccatgcccattcactcctaggttcttggcaagcccagccttgatggttgacaggtgtgggagctactggctcaggggaaagaaaattaaccctatttctgccagaacccaccctacaatagttaacacatagtttcttttataatcaaatttctaacaataccgccctcaacagagaaacaagaggctgattcattattcttacactcgaataaggagaatcttcatttctcaccatgatcaaccagtataaattttttaatcagtcagaaagctttctagtcctaaaagcactgggacccatgattatcactaaggatattacttagaggtggaaagatgaagatatgaacagctggtttagtagtcacagcagaagaccttgaaatatccctagaagagaagattttaggttgtttggcttatttggagaagaagagaaagccactgctctgttcctcctttgcatttttccctcttcagaaaagcaggctcttataaattttttaaaataattgagccattttgaaatggtatatttttgaccattttaattatttgatttgttttcgtttctgccttgtgcacagtcagaggtaaactaaaatggcttgtgctggtagtgggccatcgtaaaaagctcagatgacagtgggaaattgcttttgtgatgaagggaaacattaataaaagcttctctcatgtttacccttttaaattggccctagaggagttatttaaagtaccccattggcagtggttggctgataccttaggtgtgaaatgttctctgtccataggtggtagttgagtttggaaatatctacctttttctgacctcgtttggtttatcattgaagtttcatttaaactcttttgtcctcttgtgatatggtaaaggccttaagtctttgctcataaagaaaatattgttgtgtgtctaagaaaatgtcacattttgtgtcccacaagggtcttaagatactaaatcattctacctgtggcatcagggcttcaatagatgcaactggctagggattttattttattttttaatttacaagaaaggtaaccaaagcaaaatcaaagtaggtttttttgtttttaatgtgaatttcctacgctgccctatattcaactacacatatgagatacccaagaaagtgcactaaataacttttatagctcatttgggagtccttccgttgagtcagagagtaagaaaagattcatgtggttcagctgtccaagggtactgagcgtgagaaaccagcacaaagtgaaggctcccttaggatggcctctcttattcccactgctgtgccattccacaatgcttgtcttctcaccctcagcagtatgacaggtgctacactcagagcatctgcaaagacagttagtagaagatgagatcttttatagaaactcaaatgtcctctctggaggattcagttgataagggtacatagttggtattctatttaactttactttggttttgaatcttgaaattttctgcagtgaaaggggaggggaacttttatctattcagtagcctctgagggccaaggacttacattaatttttttgatcacttggtttttcacaacaaattcataaagtataggtgtttatctgcatctaattttgtagataaggaaattccaaccataaaaggttaaattttctctcaccaggcaaatgtgtgagaacccaaatgtttattctgatccaagaccatctctgttttctgtatcaagctttctcctctggagataaaaataggaaaaatgtaataattttttaagcaacatgtcatatgatgagtcttgaatattttctaattgaacttttcttcttggaacatagaaggaaatgacctatagagaaaaagggactagcaccaaatcacacagttctttttgtctcttttatgagtttaaataatatactcttctctaatcaagttttttgtataatttttataaaatttacttagaataacagttagatgagctttgacaacactagtgtaatcagcatcacaatcaagttcatagaacatttccatcacccagaaacttcccttgtatttatttgctgtcattctccaaccttttactttagacatcacgataagctttatgtcactatagattaatttttcttgatctagaatgtcatgtaaataaaatcatgtagtgcacagcttccttagcttgccataatgcttcttatatttgttcatgtggttggggtaacttagtggtcttttttttttaactgttagtaatatttcatcatacgcatatactacatcttgtttctccacccacttgctcgctcgttgatggacattagtatggtctacagggtttttttgcctattgaaaacaaagcttctgtaaacatttcagtgcaaggaatttcatgtctcttaggtaaataattagtagtagagttgatttggtgtattgtcaaaaaatggacaaactgatctccccagtggctattcaattttatattcctaccagcaacatatgagacttacagttgctccacaaccttgaaaacacttgctattttcaatagttttaattttagccattctagtaggtatagagcaatatctcattgtggttttacttttatttctgtaaggcctagaaagagtgaacctcttgttttgtgtttgttagtcatgaatgtatctttttcggtaaaatatttagtcaactattttgcccattaaaaaaaaatctggttgctagttttcttactgaattgtaagaatgatttttatattttgaatataagtcctttgtcagatatatgcaatgcaaatatgtccacctcatctttaggttgcctttttatcttcttgatggtagtcttcaaagaagagaagtgctgtattaattttgatgaaatcaagcttatcagttctttttatttacagttttttgcatctcatctaagtaacatttacctaataaaagatcgcaataattttgtcctatgttttcttctggaaattttaagctttctaaagtttttgagtttatttctgtgtatggcatgaggtatgggttatggttcattttttccacagggataggaattttttaaaaagattatttttccccattgaataaatgcaatatcttttttaaaaaatctatttactatgaaagtgtctatttctaaactcttaattctgttgcattgatctacctgaatccttacaacaatgctacactgttttgattactgtagctttttaaataagtattaaaataaggcaatacaacttccttctgaaaatggcttcagctattttaggtgtttgcattttcataaaaattttagaaacagtttgtcactgcttttcttttctttttttcccttttttttttttttttttttgagacagcatcttgctctgtcacccaggctggagtgctgtggtgcaatagcagctcacttcagcctcaacctcccaggctcaagcaatcctttgaccccagcctcctgagcagctgggatcacaggcccatgacaccattcccaactaatttttttttttcatagagaaggggtctccctatgttgccccaggctggtcaaattcctggggtcaagcaagtcacctgcctctgcttcccaaaacgttgggattgcaggcatgaaccactgcactcaacagcttgtcaattgttttaaaaagcatgactgaatttttactgggattgtatagcatctatatactaatttacatttcacttatatttaaagtatcttttaattgttccaacagtgttttcagttattcactgtgtacatcttgaatatattctgttaaatgtattcctaaatattccatgtttttgtatgccattataaatggtatattttacttgaaattgtattttctaattatgtcttgctagtttagaaatacacttgctttttatatattgctcttttatcctaagatcttgttaaactcatttattttaaacattttggttattgttgatgatgattctttataatgtcctatatacacaatcatgtcatctcttcacaaggacagttttattaatgccttctaatatatgtatcttttatttcatttttcttttcttcttgcacaggctagaccctccactataacactgaatagaattagagaaaacagctatcttgccgtgttctctatcatagaaggaagcattcagaattccactactaagtataatggtcactgtaagttttacatacatacctttcattaggttgagaaattttttctctaagcctagtatgctgatatttttaaacttaaatgagtgctgtatcaggggaacctgcccccagtatttcaacctaggttctttctattttccctaagtgtaggtcagcctgagaaataaagagaaacagtacaaagagaggaattttacagctaggcctccagggatgacatcacatattggtaggtccgtgatgtccacccgagccacaaaaccagcaggtttttattaaggacttgaaaaggggagggggtgtacaaacagggagtaggtcacaaagatcacatgctttaaagggcaataaagatcacaatgcaaagggtaaagcaaagatcacaaggcaaagggcaaaatcagaattactgatgagggtctatgttcagctgtgcgcatattgtcttgataaacatcttaaacaacagaaaacagagttcgagagcagagaaccagtctgacctcaaatttaccagggtgaggtttcttccccaccctaataagcctgagggtactgcaggagaccagggcatatttcagtccttatctcaactgcataagacagacactcccagagcagccatttatagaccaccccccagggattccattcttttcctagggtgttagtattatattccttgctaggaaaacaatttagcaatatctctcctacttgcatgtccatttataggctctctgcaagaagaaaaatatggctctttttgcccgactccgcaggcagtcagaccttatggttgtcttcccttgttccctaaaatcgctgttattctgttcgttttcagggtgcactgatttcatattgttcaaacacacatgttttacaatcagatttctacaatagtggtcccgaggtgacatacattctcagcttacgaagataacaggattaagagattaaagtaaagacaggcataagaaattataagagtattattagggaagtgacaaatgtccatcaaatcttcacaatttatattcagagattgcagtaaaaacaggcgttaagaaactataaaagtattaattttgggaactgataaatgtccatgaaatcttcacaatttatgttcctcagccgcagctccaacaggtccctccgttcagggtccctgacttcccgtaacagtgctgcacttttttcaaaatttgtttctccatatattaacatgataaagtggtttttctcttttattctgttaatatattagattacactgattatttttcaaatattaagtcagctgtttattcctgagatatacctcaattggtatatatttgatattttgttaaggatttttaattctgtgtttttgaggggtattggtctggttttcatacaagcacatgcttatcttgtgaaataagcagggattcttcccctcttctattttctagaagactttgtatataattgatattgactgaaatctcttaagccatatgagcttagactactgtttataggaaaaacttaactatggattcaatgtatctatatattaggacagggctttggttgttcttttttttcctttatctcaaatttttaaattttgtacctttgaatgaatttgtacatctcatcaaagttggaaattttagtaggatatatttgttcatcatagccccttattatcttttcagtgtttgtaggatctgtagtgagagctactgctttgttcctgatactggttatttcattgtctcctattcttgaccagatctctcttaaaaccagattttgctttcacttatttttctattacctgctttccatttgatcatttttctgcccttatagtcaatatttcctttctttaaactcattttgagtttaatttgctctcatttttccaggttataaagcattttaagcaacacattttcctctaaggaaacagccttacctgtatcctacacattttaaagttgtgttcttatttttatttagttcaaattatttatgagaaattatgttttacagggatattgtttaatttccaaatatttgttgattttctacatatttctactgattcctaacataattattttgtgttcagagaccatgttttataatatatcaatatttttaatttcttaacacacttgaaaagtttatgatataacttagaggatgtattatgtacactaaaaataatatatcttttcctgctcttaagtagtgctttatatagacctatcagttgcaataggtaaagttggttgatagtattttcaactttcttgttaaaaaatacaatttagaagtatttttcaatactatctcaagtatttttgagttatctgtatctttactgatttttgtctacttatgctatcacttattgaaaaagaatgttgaaatctgcaactatcaatgtggatatgtctatttcttcattcaggtctatcaatatttgtttcatgtactttgagtttcttttattagatgcatacacatttagataagttaataaagatttttattcttccttgattatttaaacctttgttatcatgaaatttacctctttatccttggcaattttccttggaatgtagtgtactttgatgtcaatacaatcattccaaaagttttatgcttagtgtctgtataatatatatttttccatctgttattgtaaattatctgtttctttttacctaaagtaaatttcttgtatgagcatacatttgggtcttgctgttttacctggtctgaataaactctgccttttatttggagtgtttgatccatttacacttaatgtaatgaataataattagatagttagataagtaagttttctatgtctttttcttgtttttgttttgctcctttgccttcttttaattcgatattttttataattatattttgtctcccctagtgatttatatgttagctgtgtgtgtatatgtgtgtatttgctctaaggtttaaagcactcatctttaatttatcaattctaccaccaagcactgttatatcacttcacattaatcaaacttataatagtttacttatttttccctactcttccttgtgctattgttatcacaatggtctagtgcctccagttaggaagctatggtaatcataaagttcatgctatgattcttttgcctcctattaatataaaaaattccagttcagcttgctttcaaatgtctggagtttttttttttataatgctttttctgtgtcttagttatctgaagtgggagtgcaagtcagtcttgtcagttagctttacatgatcaaaagcaaaattaactttaacatgatatattctttagaaataatatcttcataaacaaaaaataaattgacctgtcaataatgctagctctgagataatatttcagctgtattaaaaggtttacattaagatttgctaactttactccaactatgatcaacaaatcattataaatattttataactcatatttatgttagaaacatatggtcataggggaaaaattagaatatatagatgaagaaaaaatgaaactttcctcttatatcatacctagacatgcagattaatattttgctgtagaatttgaataggtatagttcatatattctaaagaattcatattagaaattttgagaaccataggcacagactatgaccaaataaaaaccaaaaaccaaaaacaccttctcatattcccacctccacctctgactccttaatttagatggtcattacttccacctaaattatagatacacttagcctcctacctagtttttgtcatcagttttgttttttcgtacctattctcattttgatcagaaggatttcaatcatactttatcattccatcacttaaatttcctcaacgaattctcaccaagattaaataaattctcaacttctcaatataacacacaacattttttggctctaatttcatctcttcttatttattacaaagcattacaaactctagccattttgagcacacatatgtggtaaatgcagcacccatctgctgtttgttctctgaataccctccgtacaaccccaccactaactctctttctcacacacttacttgtcttactgtttcttcttcctgctttacaactgatgcctagggttccattgttggaacactaagtatgtgggagttatttatatcctattgctcaaggtcatcaccaaggtctgattgcaaatattcaaaaattgcaacctcaggcataaatgggttaagatgaagttcaggcatctgtttgctttaggctgggttagttgtatttatttatttatttatttatttattttttgctcccacagttgccagtacactcatggttctatgataaaatattgtgctgtggtctaatattttccttacttctttgtctctctcactaggttgtgagttacttgagagcagatattatgttttccattttttaatcactagggtgcagtagaccatctggcacatattaactactcaatatgtatttgttgaatgaaataattaaaaccattactcatgtgataatcaaattggcactcttgatttcactggcactttatgttagacctctatattctttatctgtatctacaagacaacatcaatggtaagacacatcctccaataatattatgtgattctagctaaaaggaacataagaaaaattgtaactttttttctacttttcacactgaaaactgtgacatctattaaaatacttttacccaaaaccagaaatataaaagtgtatattcaataataaatattaggaaattgatgtctacagacatgtttcaaacatctcataaaagctcttttttcttttgccacttccaaattaggaccgttcttgtttttgaattcagctccaggtattcaatttagtcttcgagaattaagtcttaattatctcagtgatcatctcactgccttgcattctcaatttagcaattgatcacagagtgagcacaacatagcatttggacataaaaatcaactttaagttttgactacaatccactcagtgatttaagcacgtactgtggtctgagtccaaaaatatttcatattgataacagaggaacttttgtgattcgtttcaccttcaaactccagaatattagtatcccttaacaaaaacaatttgtattggataaaaatgtttggtataaattaggactcttcacagttcaaataataataatagtaataattagaaaacccaacctcacctaacaatgaatgtttaatgatatgagtgatttgttggctaatataaccagaagttccagaggatgaatggattatatttggctcagtttagcagctcagtattaccattaaagatccagtttaattttatttccctgtattccatagtactagcattatcccagcactgactttcttcatggtgtcaaaatgacttatagttccagacttcatatctttatgccacatctttcagaatgaaacaaaagttggctacaagtaggtctttgagaaatctgaaaatcatctttcctagaagcataattatttttgaagcttgactcaacttggcccttttatttgatcatatgcccattccagaaaaattatctgtcaacaaagaagtatcatatgctaacggtatagattttaggtccctgaatcaattactattgtggcatagggttacctcaacagggttagacctatcaaaaatcatctctggatcatggaatgaggcaattacccctaacccaaaaccaggccgtttttaaatagctaggaagaaaagtgagtcttggggataaaacatggaaatttagaaccagagctggaagtgatgaattcaaacatttttaaacaaaaataaaattccttaaaattagggttgacaaatttattgaataaaaatacttggcacccatttaaatttgattttcagataaacaacaattaaattttagcataagtatgtcccatgaaattgtacttgaaatctcatttagactgcaatatatgagttatttaaaatacattgtttttgtaaaagtacaaaaaaaagacaactttttatgggaaacaaaataaataaagataagacaaagactggctgtagttttcatttgattatttcagtcagtgaccacacatacatccagtaattatgggaatgttaggtaggaaagtcagttcaatgctcctggtcttaatgaagaggactcatccctaagtactacagaaggctcactctgccttcttactgattactaaaattgggaacagtttgctcagctctgggaggaagttgcctctcatgtataaagggcagtctctgccgttgcaggcaagaggtatcttgacccagtctgtttgactggatggataggctctctaactctgagcttcagacttaggaagcccatttcactctaactctaaaaaaattgctttaaacttagatttaattaataataggtgtgggccgggtgcggtggctcatgcctgtaatctcagcacttttggaggctgaggcgagtggatcacaaggtcaggagtttgagaccagcctgaccaacatggtgaaagcccatctctactaaaaatacaaaaattagctaggcgtggtggcacgcacatataattccagctactcgggaggctgagaaaggagaatcacttgaacctgggaggcggatgttgcagtgagctgagattgtgccattgcattccaggctgggctatagagtgagactcagtttcaaaaaataaatgaacaaataaataataataataataagggtgatagtccaggccccatcttttactccgttgtgctgtttatattttcacccttgattgcagaactttatagggaagtttatatgccctccttagaaaattcaacccaaattattctcgctaatttatatgtactggaactaagaggttatcaatatatgctacctatttatataaatggcataaattttggagtgtttactgatttagactttttgaaataaagtttaacctttatgggataatattaaacataagttccccatttttaatttattacaataaataaattatatacaattagtggatataaatattgagagtgtttctgaggatatataaaaatggctgcatcatgacaattactctcaggaatcaaaagagaagtggcactgaaacaggtgaaagaggaagtagggacaatataatgtaatagacaagaggtatggacctgagatatttagctgaatatgtgtacaaattcacatgtctggactctgttcacaaccaccaaaaaacaaccatcccaaaggaagacaaaacattgttctagaaatatagggatgccaggtggaaagatgaatatggaagtgtttgcagcaggctttacaatgctagtgatgtgctgtaatttgaattgccaccttgagtgggttttgcttttcttaccactgaagtttagatgacctgtgacgtggtttttcaaaattaacaaaacaagtacagagacagaatcatccagaagctttcaaggatattacattctggacatgaattcatgagataggaaccaccctcagaagtgggaacttttaaaataaagctattgcctcagcccatggtgggaagtttacaaaaccagctgcactttgcatctctgggtctaacaaagatcacatatcaaagcttcatgaccaaattaatgtgtagcttatccccctccccaaggtctttcccttggttttattattactgacaatattgtaagagcagtgtgaaatggccaattcacacatgtgccacgttttgcacactgcctgaacctgctggaacatgattttcctaagaatgatgacagtaataaacatcttctggcagaggcttgcaaaacctgcacccattttagtcactcagtaatggctcataaaattctttgagaactgcaggagaaaaacaatgtacatactcatgcataaattaaaactagaagtgccagctcaatggaactcgacttctcacactctgggacaactgtggagcaattaaaaataaacaaacccatcagatgtaggtacagccaacggtcatcagagaaagtgctctctgtttgagatcaaaccattaaccagtgccttccttgagctgattccctctttggtctgtgaaaatattcaggatactttacataatccttcctgatgagttctcttacaaaggcaatgtcaatgtgaatggatgagaagaaaaatgctcatcttgatttccctttacatttaaggatcattttctgcacaaaatgtaatataagcataaacattcctgattcccttctttacataaaagtttcaagtttgagctctgtcattttcatgggtgaacaattcagaaatgctctttattttgtcaagttttaaagaaagaaaataatcagaaatacctaaaaaatattctcatagaactcaaaaaatcattagttcatagagcatttctagcaatactttagaatcattttctcagccctgctcactatgagtaggactctttacagttttcagaactgaaaaaaaaaaatcggttttatggtcaagtttccatacttgtcttagcaattgaaatcttattctacagttatttggaacgttctcaggtggaaagtaatgggtaccagttttatctgtcatctaacataatatttggcagttgatacaatgtggtgtattaatactcccctcaaatagcaagatgataatttgggaatttttccccagatctggaagcaggtttagttggtcctgggatagtcccaaccaacttgccagagattgctttagtcatggtcatgtgaccaattctggacaacaagccatgccttgaggtttatgacaggcccttgggaaagttcttccttgcttttaagagagaataggaaagctttatatttctccccaatggttgtgaatgagaaaacatgtagcccctattactttgggcatttgtctcaaatctatgaagaaatgagataaagccaattgagagagagtccaatgggaagatttttgaggtgctagtattagtccgttttcatactgccataaagaactgcccaagactgggtaatttataaaggaaagaagtttaattgactcacagttcagcatggctggggaggcctcaggaaacttacaatcacagcagaaggcaaagagcaaacaggtaccttcttcacaaggcagcaggaaggagaatagtgaagagcaaagggggaagagctccttataaaaccatcagatctcatgagaactcactcactatcaagagaacagcatgggagaaccacccccatgatccaattacgtccacctggtctctccctagatatatggggattatggggattacaattcaagatgaaatttgggtggagacacaaagcctaaccatatcagtggtggattagccaacactaaaccctacctatttctgatttccttttgtattagctagtaagtaatctgttcttttaagtcattgtttcaggttttgtcacttacagtaagaggcagttcaaaagacttaagaactttacaaaatgtcctttcttattacacagtgacttatggggtggagggttgcagatgctcagttgttaagtgtatggaccaaaatgacatatggcaaagaagcaggcccattagacaatgaaagaataatgatgtaagaatggcaggctctttgtctcagagaagtggctacacctgataagaatcccagttctaccacccatgtgtaggccctcaccaaatttttctgcaactctctagggtttaatttctaatatttttttctctatatcctccttcttgactctgcacctgctattttcaattacagcccatccacctcacttgttgtgtgagcgcacacacacacacacacacacacacacacacacacaccacatcacagagtattctgtgatggtggtgtcccagatgatttggggaatcacaggaagggaaagtgagtccttcctgtataaataactgcatacatactttctgttttttctcttgtctcttcttacctattcagagccacctaccaaattctttttatgttttatgcacatgaattttatccactcctaggacataaaacttctttatttctactctaagcaatacgccaaagaattttcccaataaatgttgatcttcttctacaaggactccttttccaactgcaaaatatatatatacacacacatatatatgtgtatatattcatatatgtatatatacatatatgtatgtatatatatattcccattgaaaagtgcacttctttttcaaatttatgtgaaaattggcttaattaggaggaagatgttcttaggatactgcacctacaaaataaaattcccaaatatgaccaggagcatccttctgaatcagtgtgactctcaactccaaatgaagtttaggttttgcctgaccccttcccaagtagaaaatgtttctcaggcaacaggggcttttcccacaaaaaaggtcagttttgggattaaagagaggtacaaatgaatggttttaggagtagatacatcttaggtaagaaatagagaaaaggattcatacaagaactgtaaggctctgaattcccaggagagtatgtagagcactcagtcctgacagtaagcaccctctttgaataaatagagtcctgctagatggcaggattccaagctgatgctttgagaagaaagacctctggaaaaacctcacaatattaataaatacttgtcattagataatttcagctgcaaaaaatgcttcaaatgtctcttccaatataattcacctttgttctagatatcaaagatctcagaaaagcagttaagactatgatgtataagtcagcacttaaaagatcttaccttttaattaaaggttataaaaattattcacactcaaaatatcaactcagaaaaaaaaatctcacaatttgggccagttttgttatcctttagatagcactgaagtatttgcttattgcaatagtatagagtgtttctatacaatcacatatttttgcagatatagaggcagcacacacacagttgttgattattaattttcaaaaagaatataattaatagcttggaatcacagaatgaagaatgtaattaatagcctggaatgacagtattgttgagtgctaagaaagctatggtcttcagactggcgaaagtggcaaaaccgcatctctacaaaaaatataaaaattagtcgggcgtggtggcacacaactgtggtcccagctacacaggaagctgaggcaggataatcgcttgaacctgggaagcagaggttgcagtgagtcactgcactccagcctaggcgacgaagcaagactgtgtctcaaaacaaaacaaaatgacaaaacaaacaaacaaaaacacctatgatcttgttttggttctaaaagtttcaaactttacctttcccaggatgccttagttttctcattggtaaatgaggtaactgggtgttctgttcgttatgtaactcacagttttaaattattagatctgattttaatgagcttgaaaatacaaatcaaggtatctaatctcttttgctctcaggtttttcaactataaaagagaattgtaagataccagtagtgagtgtatgcatataacatctggagccctttttggagaacaatgcttacgctctccccaactcctgccccacccctggcatctcggttccaccgtaaactcattattagttcaggtggtttgagagaagttgatcaggttctgtcaagggaaacacatgacctgtcctgaacaatctgaccagtgattagccatggccattgttacagaaatagatatttgacccaggctataccaattaatattctcttaagacttttgctggacctaaccagaaacaaaactccctttttctgaggtgtaagcaatgagagaaatttgacttcaatttgccattggccacgttgccactacttgtagtgagaatgaaggtaaggtgggagctgagagagagagaacatttcatttcgaatcccagaattcaaatgcctaaagcctattttttgcttgtttgtttcatgagccaataaattttccttttccttaaggtactaattttccttggatttctgtcactaaacactgaaaatattgacagacatattaccttagaaatttatgaaacgtgggaggagccaagatggccgaataggaacagctccagtctacagctcccagcgtgagcgacgcagaagacgggtgatttctgcatttccatctgaggtaccaggttcatctcagtagggagtgccagacagtgggcacaggtcagtgggtgcgcccaccgtgcgcgagccgaagcagggcgaggcattgcctcactccggaagcgcaaggggtcagggagttccctttccgagtcaaagaaaggggtgacggactcacctggaaaatcgggtcactcccacccgaatactgcgcttttccgacgggcttaaaaaacggcgcagcgcgagtttatatcccacacctggcagggagggtcctacgcccacagagtctcactgattgctagcacagcagtctgagatcagactgcaaggcagcagccaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttgtcccagtacgcagctggagatctgagaacgggcagactgcctcctcaagtgggtacctgacccctgacccccgagcagcctaactgggaggcacccccagcaggggcacactgacacctcgcacggcagggtactccaacagacctgcacctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacacagttcctcaccagcaacagaacaaagctggacggagaacgactttgacaagctgagagaagaaggcttcagacgatcaaattactctgagctatgggaggacattcaaaccaaaggcaaagaagttgaaaactttgaaaaaaattgagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacgttcagattcaggaaatacagagaacaccacaaagatactcctcgagaagagcaactccaagacacataattatcagattcaccaaagttgaaatgaaggaaaaaatgttaagggcagccagagagaaaggtcgggttaccctcaaagggaaacccatcagactaacagcggatctctcagcagaaaccctacaagccagaagagagtgggggccaatattcaacattcttaaaggaaagaattttcaacccagaatttcacatccagccaaactaagcttcataagtgaaggagaaataaaatactttacagacaagcaaatgctgagagattttgtcaccaccaggcctgccctaaaagagctcctgaaggaagcgctaaacatggaaagggacaaccggtgtcagctgctgcaaaatcatgccaaaatgtaaagaccatcgagactaggaagaaactgcatcaactaacaagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagatacacataggctcaaaataaaaggatggaggaagatctaccaagcaaatggaaaacaaaaaaaggcaggggttgcaatcctagtttctgataaaacagactttaaaccaacaaagatcaaaagagacaaagaaggccattacataatggtaaagggatcaattcaacaagaagagctaactgtcctaaatatatatgcacccaatacaggagcacccagattcataaagcaagtccttagtgacctacaaagagacttagactcccacacattaataatgggagactttaacaccccactgtcaacattagacagatcaacgagacagaaagtcaacaaggatacccaggaattgaactcacctctgcaccaagcggacctaatagacatctacagaactctccaccccaaatccacagaatatacatttttttctgcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccaccagagaaagcaggaaagatccaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaaaaaaagggagaagaatcaaatagatgcaataaaaaatgataaaggggatatcaccaccgatcccacagaaatacaaactacaatcagagaatactacaaacacctctacccaaataaactagaaaatctagaagaaatggataaattcatcgacacatacactctcccaagactaaaccaggaagaagttgaatctctgaatagaccaataacaggatctgaaattgtggcaataatcaatagcttaccaaccaaaaagagtccaggaccagatggattcacagctgaattctatcagaggtacaaggaggaactggtaccattccttctgaaactattccaatcaatagaaaaagagggaatcctccctaactcattttatgaggccagcatcattctgataccaaagcctggcagggacacaaccaaaaaagagaattttagaccaacatccttgatgaacattgatgcaaaaatcctcaataaaatactggccaaacgaatccagcagcacatcaaaaagcttatccaccatgatcaagtgggcttcatccctgggatgcaaggctggttcaatatatgcaaatcaataaatgtaatccagcatatagacagagccaaagacaaaaaccacatgattttctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcagttaggaaaagaggaagtcaaattgtccctctttgcagacgacatgattgtatatctagaaaaccccattgtctcagcacaaaatctccttaagctgataagcaacttcagcaaagtctcaggatacaaaatcaatgtacaaaaatccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatgtaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacacggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgtacagcaaaagaaactaccatcagagtgaacaggcaacctacaaaatgggagaaaattttcgcaacctactcatctgacaaagggctaatattaagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaattaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattcagaaaatgtggcacatatacaccatggaatactatgcagccctaaaaaatgatgagttcatgtcctttgtagggacatggattaaattggaaatcatcattctcagtaaactatcgcaagaacaaaaaaccaaacaatgcatattctcactcataggtgggaattgaacaatgagatcacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataataaaagaaaaaataataataaaataaaattaaaaaaaaagaaatttatgaaacgtttagttagatacactgtgcaaaagggttgtttaaaatgcaagtaactatgcaaatatatgacagctactaatatttttatttttctacaataaaatttagaaaaatacttttacataagaataaaatgctatcttaatcaaaagcagttacaaaacacctaattctgttcactgttatcctcgaggctttagggaaatttgttttatttatttcattgtcaagaagcccagttaatagctatggatttgtttctatattatccagtcgctaagtaggaagtaggaatacattttccttacctcgtaatatagttttcactgtcttttctagcatgcttataacacttcatgcttttagaagaaaggtgctaaatgctaagaattagtattcaagtgacttcaataagaatgaaagtagagagtttgtaaggtatgctaaatctacaagattttaaatagggtctcacagctttaacccacaaattctggactaacccacttcaacaaagagtagtttcaaaacctagtttgcaaaatgattacatggttaatgcaggattaaattttctttcaattataagactgaatctggaaaatactctacagagaatgaaggaaaaaataaatcctgcaagaggtgcatttggtctaaagtgcttttaaatatgcttcttaattgctgggggctattttgctcttcatctaatcattgtctgaattactgaaggtcaacttatctgataaaataggtgagctttgtggtaatgaagtcagataatgtcttatattcgtgtcagggtaggcatcaaatgggcaatgtatttaactattagtatggagtttgcagactggaatactttcatctaggttttttatatgaagccagttcattgaaataagtaaaggtttcaaaatgggaaagcatataagaaactgtggctttaactgtttaataaaattgcttgctatttaagtaaaggtaattaaaagtgtaatgccgtggaactattacgcacctactcaaaaacgcgtggatttttgttttgtgaaagagccaatatcttgaagaaggggtaggcttcacaatgagaatcccatagatacttttaaagagctggagattaactcatttaaataaacagtcattttatggctttttcaccagggaggccagcatttccttggggttcttgaattagggagttccacaccaaggttctgtaaattagctatgtgggtattcatattatcaacaccttcaccgcagcaggaggccccacatgggcaaaaatcaaagaaatgtagtaatcttctgactatagcagattactctgctatagtacttttgcttctgcctagagcacttttggttttgctttgcacctgacttttcaaaaaatatttctttaaccactatttgtttgattctgagtaacatgtattggaaggccaagtctatctgcatgccttttcaggtgttattctgacagaggagtttttatacatgttggttttatagcataaaatatgaaaatttataaaactgctcagtacaagtttaagggcaggtttctgtaaaacacagagatattttaaatgaaatatacaaatgtactggctccttcatgatttttttacatgaactaaagcaaagctatattcacatatgaaaaacatccaatttcatttcatcctcccctccccaacatatggtaagtatttccttggtttctaaatctgatgcatttccaaatacacttggggaagaagtgtaagttactatacttccatctgatttttctcagagaaatttgtacaacataagttttacagaatggatgagttttattaaaagaaagagcatttgtccgtgcaatgcctaaaaaacctgtgaaagtgcaggtcatagagagaaaccatggtattatttgctggctttctgtcaacaagaaacttttccatcctcatgtatatcctgaagtcaagtgcacatttttagtagcaatggtccatgagaaagcaataggctatcctgggtgtctgggccactgggttggtcaattaaaggagactgttgagtcatgcattctaccttgtcacatttgtctggttttgtttttctatagaaaatcaaagcaaacaaagcagctctcagtaatgcattctaaaattgtcatgaattaactgacctctgtagaaatgtccttttcctgggtcaattcagcaattttgtcctgcttattgttttctaaatacatcagtttcattttgtgttgaacatcaaagccctcatgataagtactatgtttaactacaaggctgagttgctcaggacctgacaagtcatgaagcattagtagatgattggttcttcccgtcttggaactcagcctaatacatacagtatttaaatagggaaatcgccattgactttgtaatcccttgtgtgacacttgttctgtgaacagataaaggagaagtaagtcaaatacacatttgttgggaagtctccactgtctcttttctccccaaaggcaggaactgtcagcattggtgacctcaagctagcccatgttctgatattatggtgcacattcccagggaggattatttggaaggacttttgtgaagggaaacatttcagctgctttttacaagcactgattgcccaggacaaagtaactgactgctacaacattgaagctgaaggacataaacatactataatatgttttgtcataaacaatcacagattaaggccctcttcacaggtgattgaacaaaatgaataacagaatggagacttgtattctaatgcttgttgctcatgtaaactcatgttctgcattttagaatttgttgaagccatagcttctgctttgggaataagccacattaatcaggtcattcctttaggtgtattctgaagtagctacttttggtgattaaacttcacatattatattaggtaacacagcatgctgttaacagcatgttatcagtaaaggcaagagaaagcatttattttagataaagcaggctaacgtctgtcaactataacactgctctctgatatcaaggtaagagtaagctacagaatgccatcagcaatagcaaacatatgctgagtgcctactatgtgctgggcaatatatcagatgctgagaagagttatattataattcataagggatataaaatagcaagcaattcaaagtagtaaatagataatctgccatatattttagaaatgtattaagacagaagttgctctaacatttgagagttaaagcaactaaagtccttgccatttatgagacttgatcaagcatacatagtctgtatgaagttttgaataaatctgttattctatcatctatgtagtgagaaactaggaaaataaaccaggagttttgagatctttaatccaagagataccttgtagtttgggcacaaactagctttccagtttttttcttctgggactagtattatttgcatttaagagcttcaaggaaactttgactgataactccaaatatgagttttaagctagcataaagtatcaatttttaagcaatagacatcatgatatttttcatcgcctttcacatgatggcataagtgaagcccaaatggaagttcaatgattccatttcagctataaaagattcaggaagattagaacctcagtgactttcttgtatagtgattttttaaaaatatgttttgctgaacgagagggctgtcatgaattaaatgcaactctgcatttagttagtattcaattctattcttccaataaataactggatgaaaatcatttaaagaaaagcccttctctttaaggaaacatctttagaccatttttatgagatttctctagcagaccaacttgcaacttctagaaaaataacccaaaccatgtaaatgtactaaagagagatctccagggaagcacaacctcttagttctgtctttatacagctcgtggtgaatatggagtagaagaaaattgtggtttcaacagaattcaaacattattgtatcggatctgaaaacatttattcattaaggctaaaataaaggaaaacattttgaaaaataacagccagtaatttatgtctggctgggctagatctaaacttgagttctggccattttcatgtatgttatcgtgaatatttaccatgacaacatctgcatagcattacctactcacttctgagtatttaatgtacatactcttaataaacatgttccttgtggtctgttatatatatttttaagaccacattaaaagaatcagaagtggaagagatattttcaaaaacttaaacatggacatttctcatatggagttttgaaaatgtgcaatatttgctttaataaccagagaccatattataaaatgcctgtagaaacacagtgaatgaaaaagtctctaactttaatggtttcaacaaagtgttatattttaggaaacaatgaaatggaactcctatgaatatagatagtagaaagaatggagaaagtgtgtatctattcattatttgatggagtcctgatattttcttgtaaagtagctgtaaaagaagtcctaatataaatctgcaagtgaaaaaggaaagcatgacatcagtctctcttatagttttgaaaatgctaaagcaaaatcaaactgacaaaacttgaagagctgctgctaaaattggcataatagtgtttaattgaaaaataatgtgatgtaaggtaaataatcagaagagcacgtttccaggatttcttgccctcaaagtaatacagataggacagtacacatatacggttatcagtttggaagaacacttgaatgaaggcactgaaaagacagaaataatggtgtcttcttttgctttgaagcttcctgattggaatgcagtcctttagggtgggagaatctgctttatttagagaatagcaattcaaaccattcttttccactggaaatatttgtcacaggaagattttcccatagtaaaagtgttttgttaataaacttttttttttatgttgaggtcccttacatgtaactaactggaaccatgctttagccaaggttttaggcaaacctcggcctttgaattgtacaggcttgacatgtcattgcagagacacgtcacactgcattatgctgtcgctttgcatcccttggcatttcactgacatactgcaggctcttgttctacttttttgtgctgctttccacggtccccattacaggctccaagacccaacaactcctgcaaaaattgatagcattttttttgcctgtgaacaatcacttccttatttgaatgactttaaaaaaatgagcctttggttcttagtgtatggaaaaaaagtttacttagggtgctttcagcctattcaaatcaccagcagctctctgtatccagatgtaaagcggggattccaaatctgcagaaataaactgcatgaaacatattaaaataaaaataagttgatttaagtaggatataaaaattaggtttaaagcgcaaatataggtaatctccttatgaaaaatacagtattttatgattacagaagttactcatttttatagtagggagctttggcaggagaggaaagtaagcaaaatgaaaaaattaaaaatcgtgtaattcccacatttaaaaatagctgcccatcattttgtctatttctatttatatctagagcgatactgacatgtaatgcacacacataaatgatatcacatgcaaaaaaattttaacaagaaattatattataaacatgtccccggtcattaacatttgtgtaaaacattatgtccatgtattcttattgtttgtgtggttatgctatatttccttaagataaatttctcaaagaagaataacatttatctagatggatatttaccaaattccacctcactccctcagaatttgatgcctctttcccaggtccttatgaacattctcaatgacagtgtttaaaagtgttggttttcccttttcttcatcaacactaggtattgccatttgttagcataaagagtataatctttgccattctgatatatagaaaaacagttacatatcactttaatttgtatttcttcaacagctagtagagcaaagtcttttattacatgtttctggtcatttgtaattgcttctggcaacaaacaaacaaaaaaccttaagcaattttttaaaagcccatgacattttattttaaaggtccattttaaagcaaaaaagtaaaattgaatcattgccataatcagattacttttaattaaagcatttcacacctagagccctcttgggaaggtatgaagtttttacttcaactaataatccattcttctgtaacctaaatggttcctatttgaacaatgaaacatgcattattcctttaggacacatgatcagtagcctcgggataaaaacaaaaccagaaatattcagtgtttggatcataaaatctgtctcttctccccagccccaccagtttctgtggtatatcattatggttctttctctacagctttctgtatctccctatttctagcttcctttttcatttcaacttttatttcatatctctgcagtcccatgaagtaagttcaaagtcttgctttcttacatatgggatactttggaattgtttttccttaagttttatttcttgctcccagtgagaacaacacagatgactaaaaaatgagattgcatttcttcaattattgcagaaaaatacctatctcatatgcacattgaagatttttaaagatttatctttttgaagtaataaaacagaagataactgctgtagactttatcatatgctaggaacttttatgcagtatttcatttaatacacacagaagtgatatgagattgaagctatagctcccatttaagagatgagagaactgaggcctgaggacttaggtaaatggaattaagaatatctaacccaagggtgttttttacataggaatcaaaacaatgtaagtgaaagtgtgtgtgtgtttctgtgtgtgtgtgtatgtgtatgtgagtgtagcacataattaaaactgaaatatattgttaagtaagtgctcacttaaattctctgccaggaaagcaaaacagaagtttcctcatctcttcagatgttcgtctgttttgtctttatttgtctcaaatctttattcactttgttaaagatgtttcatagaagtatcaatatttatctgcctttcaaggctgctcctaacccacttacccattcacccaagagcagagtccttgggtgaaatgttatacacttaagatatatatcccaagaaccatgacaaacaggatgttgggttgtataacatacgctgcttccaaatgtagccttggaaaataatttttttttttttgagatggaggttctccctgttgcctaggctggagcacagtggcaagatctcagctcaccgcaacctccgcctcctgggttcaagcaattctgcctcagcttcctaagtagctgggattacaggcatgtgccaccacgcccggctaatttttgtatttttggtagagacagggtttcgccatgttggccaggctggtctcgaactcttgagctcaggtgatccaccctcctcggcctttcaaagtgctggaattataggcgtgagccactgtgcccggccagaaaataattttttaaaaatagtttaaaaactttattttactaattcttagtaagggaagtaatgtaatgtaaatgcacacagtattttaaagtttacaaaccacttctatgtatctacttgactctaatgacttagacaagaaggcgttattttctttcttgagttgacgaaactatagcacagagataaagtgacttggcaaaggccttatccagctagaaatgtgcaattccagacttgcaatggggtcctctgaacttaaatcatagttaatcccttacctttttctatgcctcagcagtagtactcattcatccatttattcatgctttcagagaataattgttgggcacatagtatgtattaaggtcatagtaagacttgagagttaggggcatgaaaaacctagcctttactctcttggaacttgcagtctagttcatggtttctacatttaaacccaactagattatatcacaatatatgttccagaagtgtcccagatttggaagagtggaggaaagaggatccatgcgtctgtgtagaaagaaagacatctttaggactgagtcagattttaaaggatttgtggtttgtcaggtattaaggataaggaagctattcctagcagacctaatagcacatgaaaagtcatgacgaaaatgtctgatggggtatctgtagcaggatgggctagaaagttggctaaataaaagggactgagatgaacaatatgacatgagtttgtagatatagtcaaaccagattatgggggcttgaaatcctagcataagtacatgagttctatatcatgtagtgtggatgtgctcacatggataagtgtgtgtgtgtgtgtgtgtgtgtgtttctgtgtgtgttggagggagggaagggtgtaacagtttttgaacactcctatccattatctttaaataaagaacctcatttactcttcatgccaagccttttcagatggcattattattcccagttgcagttgggagaattgaagcttagagagtaaaaaaaaaaaaaaagtccatggttaccctgcttacaaattacagaactggtgttaaacccaaggtatatctgaacccgttgcccatgctctttgtactgcactactaaagatttttttttaaagtagaagaccaatataattagacatatgttatataaagataatttgcaacattttaagagaaatgtgtaaagatgattgtccaagtgagaagggatagatgcctgaaaatagagatagtaggtggatttgagaaatacaaagaagggtttggggaatgatcataaagagctatgtaggataacaactgagaataaatgacttttttttttagcttgaatggctgttataatgtgttgtcacttatttactggagaagattcaattattactagaggacattcatggggaaaaaaagagatttggaccaaaaaagatgttattagtttttaatatatcaaggatgtactccatgagtgacatttgttaccgattactagaaacagaagtgaggacagatgccagggtcagtaataggcattaatgtggagataatcattgaagtgataggcatgagtgagctcctttaaggagaacacgagaaggaaagacaaaagatctagaattgggggaaaacctgattttaagatgtaacataagatttgtatattttaaatcatggtagatttttatagaagaaatcttgatcaatattttaaaaagaaaggaaaaaatataaaacatattgctagaatggacactaaataacatgtcaggaataagatcacaaatatcaataattataagaaaatgtaaaaacattttatttgttcattaaaaaaaaaaacaagattgtcataaagaccaaaaggaatatgtgagctgtatgctatttacacagaggtgcagctgaaaaaataaagaaacaaaaatgttaaaataaagaaagaaacagatatggaataggccattgtaaatgaaggaaagcagaactagcagattcaatatcagtcaaagcagaatttagggcaaaaactgctgagtgggagaaataagaatttatcattttaaataaaagtacaattcacaaaacttacatgaccaataaaatattagtgtgtagaaaatatactattaagcataaatcaagttaaatatgttagatattgtgagaaaactatccctaaccatgttttccctgtactctcacaccacaacaattattaacacagaagacttctgcgtccacatgagtggaggtttttttcccaacacaccaagcagcggtcaccagttgggtgtcctctaattcagtctcgatactatctaaccagagacagtgtcagatgtgacaggttgacaagttgaaggctcacttccctaggactcccctccccccacaccactgacaccagtcacgcaagttgggcctctggaacttctgacagaccggcttcaggttggggttcccatgaccccctctttcggttcgattaatttgctggagcggctcacagaactcagggaaacacctacttatatttataagtttattataaaggatattgcaatggaaacagttgaagagaagtgtaaagtgaggtattataaaagggctatggagtttccccgccctccctgggctcaccacccaacaggaacgtgttcagctatcctgaagttcaatgaaccctgtcctcctgggtttttatggaagcttcatgatgtcagcatttcttcctccaggtataggatgagaccctctcatgggagaggcttaaggcccaaattcagaaaggcagggaaatattagagttctgcctgggggcaggcgaaaggagagcaagagaaggtcagaggcctgcccctgaagccccacacacccaacattataacaaaaggctataataagggctataggagttatgagccgggagccatggatgaaaaccaatctgtatcataacaccgcagatggaaggagaagtaaggagaatctgacagaaccgtaatcatactgaaagactttaaaattttctctctgaattttctagaccaagatggcaagaaatatatgatactaataatagataattaaataatataattaatacatttgatgagtgtttttatgtgtaaaatttaacaaacagaaattcacattatgtaaaaattcattttggaatgtggtcgtttgaccataaggaattaaaactatgagtcacaaaaatgctaaccacttaataataaaaaatctagtaagttaagatctaaattagcactttaatttactcctgacttagacatagacactgaaaatgcagactagttaaattaggcactgtattaaatctatgtctcaaaaacttcacaatgcagctaaagcaacattcaaaggaaaattgataaaatgtatttgtttcaaataaggttggcaataatcagtaaactgcagaagaaaataagtttctcaaaaccatatgaatttgatgctaatgttaccttcatcttataaatgaattaattgtggctcagaacctataaaaccaatagaaaatgaccaaagactttggagttagattttttttttttcttttttctttttttgagacggagtctcgctctgtcgcccaggctggagtgcagtggcgcaatctcggctcactgcaagctccgcttcccgggttcatgccattctcctgcctcagcctcccgagtagctgggactacaggcgcccgccaccacgcccggctaattttttgtatttttagtagaggcggggtttcaccgtgttagccaggatggtctcgatctcctgacctcatgatccacccgcctctgcctcccaaagtgctgggattacaggcgtgagccaccgcgcccggcctggagttagattttaaatggagtcctgattgcaccgcttactacctaggtgaacctgagaaaattgcttatcctacatgaatctcactttgttcagaaaagtagagaattttgttgtgattaaacaatattatctgtgcaaacttcttagaactgagcctctcatatgggaagccctaaaaaaattctatttacgaggtaaagcacaatttacaatctcaaaatacagtaggcagacaaacttgcacttgaactcctattaatcattacactattcttttgacataccataaatatattggcaaagaagtttatgaatcactactataaaactatgttaaatcaagagcaaggccatgttactggataaaaagtatagattttgattctccccaaattaatctataaatttaacaccttcccaatcaaaatctcagtactttgaggaggaaagggacttaatatttagcagtttttcataaaaaataaatctgtggccgggtgcggtagctcacgcctgtaatcccagcactttgggaggccgaggtgggtggatcacgaggtcaggggatcgagaccatcctgaccaacatggtaaaaccccatctctactaaaaaatacacaaattagccaggtgtggtggcacgtgcctgtaatcccagctacttgagaggctgaggcaggagaatcgcttgaacccaggaggcggaggctgcagtgagccaagaccactatactccagcctaggcagcagagtgaaactgtctcaaaaaaaaaaataaagaaagaaagaataaatttgtaaatataaatggagggagagagagactcctcttttaaggaaacagtaattatagcaatgtgagtttgcagaaataggcactcaggcaaatgagaaaataaaattatagaagcagacctcagtataaatggaaatgtatcatattttaagagttttattctaaatcagtgaggaaagaccaatgagtgttattggaaacttgttaaattcttacctcataccatatttcaaggtaaaattttattaaaatttaaatactgacgaaataatgaaagctctagggtagtagatagtgaaatatatcctataagtaccaaattgacaggaaccattctacctcaaaacaaacttctacttcaccaaaacaaaataaacaattataacaatacaaatctcatgctataaactatcaaaatatagacagcaaactggtaaattatagtaaccatgtatgtgacaaaataggttaaaatccttaatatttaaagatctcctagggcatcaaaaagctaaatgcctttttcctggctcaatttcagcagtagacaaatggcttatagagaatattattaaaagaaaacacttaaatgtccaataaatttagaaaaaatatgtttggcttcaatagtaactatatatattatatatatatataatatatatattatatatatattatatatagtatatatatataatatatatactatatatattatatatagtatatattatatatatagtatatatatattatattatatatatatatataaattttacttttaagttccaggatacatgtgcagaacatgcaggtttgttacataggtatacgtgtgccatggtggtttcctgcacctattgagccgtcctctaagttccctcccctcaccccccaccgcccaacaagccctggtgtgtgttgttcccctccttgtgtccatgtgttctcattgttcaactcccacttatgagcaagaacatgcggtgtctggttttctgttcctctgttagtttgctgaggatgatggcttccagcttcatccatgtccctgcaaaggacatgatctcattcctttttatggctgcatagtatcccatgatgtatatgtaccacattttctttatccaatctatcattgatgggcatttgggttggttccatgactttgctattgtatagagtgctgcaataaacatatatgtgaatgtgcctttatagtagaatgatttatattcctctgggtatatgctcagtaatgggattgctgggtcaaatggtatttctggttctagatccttgaggaatcaccacactctcttccacaatggttgaactaatttacatttcccccaacagtgtaaaagccttcctatttctccacagccttgccagcatctattgtttcttgaccttttaataatcaccattctgactggcatgagacggtatcccattgtggttttgatttggatttttctatgatcaatgatgttgagctttttttcatgtttgttggccatgtaaacgtcttcttttgagaagtgtctgttcatatcctttggccactttttgatgaggttgttttcttcttgtaaatttgtttacgttccttgtaaattctgaatattagacacttgttagatgggtagattgcaaaaattttctcccattctgtaaccatatattttaatcaaatcagtaataaaatataaatttcggggtttcagtaatgaaaaagaataacaatcaccatattatatgaagtgggaaaactagttgcccaatacactttgctgagactaaataacttaccaacagttctatgggctgtttatgtaattatttatcaaaaatttaaatttacatcactcttaactttaaaaattctacgaatagatattatactagggaagtctatccgttaggatgcttttgaaggcaaataacagcatacttaacctcatattagcttaaactataaagtgagtttaataggtctatcttagacaacagtatcttgcttcaagttaggtgtgaattaacagctcaagagataaaatggcaacaacatttcttcctctgattatatctgcttcatctgcatgcagttttgcattgggcaatagatcttgtgtttcaatactgattggtatgaattccaaaaggaacattattctaggttcaaatccagcaaagaataaaaattctgcttgctttataactaaactaaaagttgtgaaattgagactttgggttatctgactcaaaccatgtatgatacatatgtacattatatatatatatatatatgtatgtaatgatacatacatacaatacaaagattgaattatatatgtatcagtttatacttttgttcttatttcaactgtaatttttttcaagtgatgggagagaattgttaaaattatatctgagttagacaaagagtattcccaccaacatttttctccctcatccttctcctcttcctttcctaattacagacatatctcttttttattgtgcttcattttattgcacttcacaaatactgtgctttttacaaatcaaaggtttgtggcaaccctgagtccagcaagtctattggcaccattttcccaatagcacgtgctcactttgtgtctctgtgtcacgttttggtcattcttacaatattttaagctttttcatttcatatttaggaaaaatatgttaggcttcaatagtaaatatatattatatttactattatggtataagtatgttatgttgtggttatcttgtggtgacctgtgatcagtgatctttgatgctactattgtaattattttggggtatcaagaagcatgctcatgtaagacagtgaacttaataaatgtgtgttctgactgctctaccaactagccaatgcaatctcccatctccctccctctcctctggcatctctatctcctgagacacaacatttaaattagaccagttaataactttacaatggcctcaaagtgttcaagttaaaggaagagtcacaaatctctcactttcaatcaaaggctagcatgattaagcttagtgaggaaggcatgtcaaaaacccagacaggccaaaagctagagctcttgcactaaacaattagtcaagttataataaagaggaaaagttcctgaaggaaattgaaagtgttaccctagtgaacaacatgaatgaaaagaatgtgaaacagccttactgctgatatggaaaaggttttagtgatctggatagaagatcaaaccaggcactcccttaagccaaagcctaatcaaaacaaggccctaactgttcaattctatgtagtctgagagaggtgaggaagctgcagaaaaaaagttggaagctagaggaggttggctcatgaggttcaaagaaaaaagccaccttcatcacataagagtacaaggtgaagcagcaagggctaatgtggaagctgcaagttattcagaagatctagcttagataattgttgaaggtggctacactaaataaccaattttcaatgtagacaaaatagccttctattgaaagaagatgctatctgggaccttcatagctagaggggagaagtcaatacctggcttcaaagcttcaaaggggatgatgactgcattagggactaacgcagctggtaataaagttgaagccaatgttcacttaccattcagaaaatcctagggcccttaagaattatgctaaacctactctacctgtgctctataaatgaaacaagaaagctgcaatgacgacgtggtttatcaaagactttaagcccactgttgagttctactgcttagaaaaaatatccttttcaaaatattactactcattgaaaaggcacttagtcacccaagagctctgatgaagatgtacaaggagatgattgttgttaacatgcctgctaacatatttattctgcagcccatggatcaaggattaattttcacttacaagtcactctttaagaaacacattttgtaaggctacagttgttgtagatagtaattcctctaatagatcagggcgaagccaattgaaaacctcctggaaagaattcaccattctagatacctttaagaacatttgtgacttatgggcagaggtcaaaatattaatattaactgcagtttgcaagaagttaattccaaccctcatggatgactctgaggggtacaagacctcagtggagaaagtcattgtatttgtggtggaaacctcaagagaactagaattagaagtggagcctaaagaagtgactgaattgctgcaatcttatgataaaatttgaccagatgagaagttgcttcttacggatgaacaataaaagtgtttcttgagatggaatctattcctggtgaagatgctgtgtatattgtttaaatgacaaccaaggatttagaatattacataaaccttatttgataaagaagcagcatagtttgaggggattgattccaattttgaaagaagttctatggataaaatgcaagcacacagcttcacatgttacagagacatctttgaaaacttcattgttgccttattttcagaaattgctacagccactcaaccctgagctaccactaccctgatcagtcagcagccatcaacctctaggcaagaccctccaccagcagaaagattacaatttgctgaaggctcagatgtttgttagcattttttagcaataaagtatttttaattatgatatgcacattgttttgcaaacatgtgtttgcacacttaatagactataggtagtgtaaacataacttttatatgcactgaaaaaccagaatttcgtgtgacttgctttactgtggtggcctggaaccaaactcagtatctccaaggtgtgcctgtattggttttcagcactttgactataatgtgtgtaggtgtggttttctttgcatctatcctacctgaagagtgttggatctcttatatcttgagtttgaaatttttaattaaatttagaaatttttcagccattgtttatctggatatatttttctgaaccattatctcgccctttttctaggactctaattgcagatatgcagaatggcttgatttagcttcacaggtcattctggctcaattttttttttaacttctgctgtctgtgctttagttgaatatctcttggtgcgtcttcaagttccttaatccttttctcttaaatattcaatctgcttttaatcctcttgaatgaattgtttgcctttttcagttctggaatttccatttagttcttcttttgagtctttatatctccacagaattcttcattttttcactcattatatatatcttttcttttatttaatacattttaatatttaaaagtcattgtttgctaatcacaccatctataattgtttctgtgactttctctataatgtcttcctatccaaatagaccaaaaactttacaacacagagattatgattggctgtttctcttctttatccaagagtaaatacctaatatgtatttgttgagtgaaggaatgaatcaaagaacagtcctctaagcaccacaagctttacaagtgcaatgccataaaaaatgctcataaagacacttgtaacaaatttttgaaccaagccccaaatataaaaatggttccagtggcatatatatttttcaatattaaagttatagtaatggaagtcattttactcaaatgctttttaatttttcatagttgatactaacataaggatttttttgtctggtagtgccatagatggagcagagtgaagcaagataaagcctgttgatttttcaattcttgtagttttcctaagcttgcaggtgagtagtcatcatttttatgattctctttttcaaaaccatccacaatattttctgtggttcctgtgtgattcatctatagtaggttgttcatgtaaagaccacataactgcaattggctattctctctctctctctctcaaaatttaactggtaaagcagcataaagcaacacaaatctcagtgagacgccattaagtatacctgatcttggaagctactttctttaaatacatttagaatttaacctgactgtaggtttcagagtccatatcaaatcccatgtggaagtcagcccctttgaaaaattctcataagtttaccagtggacaagaataacgtagttaaaaaacaaaagtgtgccaagtagagtcagatgacaaatctccagtatccagtatatttttaaaaatatgttactctatttgaaccaaaggtatggagctgggaaattccaacaataaaatgactatggcagttcctctgatctgaaggggatacgttcccagagccccagtggatgcccaaaaccacagataacagtgaactctactgatgctatgtattttttcctatatatacatacctatgataaaatttagtttataaattaggcacagtaaatattagaaaaagtaactaatagttaaatgaaacaattttaacaatatattgtaataaaagttatgtgaatgtggtctgtctctctcagaagatatcctattgtgctgaaccacaggtaactgaaggtacagaaagtaaaatagtgggtgggggtaactatcccatgtatatcctggcacacatagccctggctacacatagcaatgtctcaaggatcaagtccctaactccttttattttatactccagactttctgcctttctaagaatcttgaaaaataagagactgcattttgtttttgtttcattaaaggcgggtgtagtgaatgtttatagaatatcaataatgtagtttgtagctttgcataattaaaggcaccccttatgttaataaaattacatgaaaagaggcagtacaaaacaaagcattaatatgttcacacatttggtcttatttcaggcaagcttaattacaaagacatgggtgtctgctacacctataaaaatattttttgtcacttagagctatcaagccttatacccatttatgatattagtgaaaaagagcaaacatcatcataatggcccaccagtgaatacttgcagccatggctgtgtagactatgaatctgcaaatagaagcatatgtaaatgaacaaagactttccacacacacgcaaaagaagataatatgttattctctgtgtctatgttaaagtgccaaccaacagaaaaagctgaggagattcatttctcacgtgcatcattagtgtcagatgcagcaattgtgataatgcaaaatccacagttgctttaagtcagaaaacccagactgagttctagcttctcccgttcctcacttcatgccattgggcaagacacttaacttctctgagccccaaatttttaatttttgaaggttaaatcaataatttataagtcacgcacttggtatgaggactatacaaaagttacatagtgatttatatttatgttaataatttttaatatctagtgtctgacacatattatgcaggtaacaaatatttattccacttcctcctcttgtctgacagaattgtgaagatcaagtgaggtagtatatatgaatgaactttatatgaaagagataaaatatagctattttccttgttgttgcaaagaatatgagcacactaagtttctacctaggaacaaacaattgaactgtgattcattttaagtttacaagatagttcagggctggattttttttttttttttttttttttttgagacggagtctcgctctgtcgcagggctggattttagatagagagcagcaaagctcacaatgtttttggataaaatttaccctgagcatccattcagagagtgaactaactctgagacaatcacaggcaattgggacagcttttgggactataatatgcatatgagtcccgagcatgctgttccttacatatgcagaataaacaattgcctacataagatttgaagcaggtactatgcaatccctatatttccataaatagccaggttccaaagtgccttatattccatcaagggagattcattttaccatcattggtataggggttacggaaaattacagaaattaaaagcactttgtaagccattattcacttaacaaactagactgattatcaccttcatcactgtcaccattgccatcaattggttctattcccaacaaattacgtctggttgagaaaataggtaaaattcattcacacaaaaatgttaggtaaaggacaggagagatcaagatcactatttgccttgctttggtaaaatactgggtaaaaagggtgacctaaaatatggaaggagtcagaagaaaaaaaaaattggtaccaattgtaacatttgttaataatctaccaaataatgggctaagctcattacatgaattatcttatttaaggaattagttaagggatgatttagcacatttacaaatactttataagagaatttggagatactaatgctctccggatataaagcttggaatttcattagccatcataagcttataaagtaagctaccctgagaacaatgctggcaccccaagcagggcagagtcaagagaatcacagatacatagtgtcactgccatgattaagggacatgtgaagctcaccatattctcttattccccattaatgtgcacttcgtgaaaagtaaactataaaatgtaaataaatagcatagggcctgcctggatgctatatttggcttgctcgacccctccaaatgtcatatggaaattttatccccagtattggaggtgggcctaactagaattgtttgagttatggaggcaaatccctcatgaatgtcttcatcttactttattagttaccaagaaagctggttgttaaaaagagcccagcacctcccccacccttttcccctctctcttgcgtcctctctcccttgccatgtgatctcagtacacaccagttcctcttagccttttgctgtgagtataagcagtctgaagccctcacccaaagcagatgctggcatcatgcttcttgtacagtctacagaactgtgagctaaataaacctttctactttataaattacccagcttcaggtagtcctttatagcaacactaaatggactgagacactggcctaatgcctgtaaggttttgcctatgtataaccttattatgagaatatcacctattccttgtgtatacccacattgttgaaatccacccattccaaagtatgtccttcaaagagtggcacaatttatatctagaaaaaaattaacataagaaataagtacttaagaaaattgtcttccttaaattataatctatttaaagagtgtgggatgtgtgtcaacttgactgggctacaggtgcacagacatttagtcaaacattattctgatcgtgtctgcgtggatgtttccgattagattaaatttaaatcaatagatgagtaaagaagattgccctctccagtgtgggtgaacctcatccaatcaattgaagaccataatcaaacaataaggctgagtaagagggaactttcttgcctgagtggtttaagctgggacattggtcttttcttgccttcagactcaaaatgaaacatctgctctttatggcttgagcctgttggctttttgactagaacttacaccatcgggtctcctgtttcttaggccttcagatttagagtggaactataccatcatctctcctgtgtctccagctttccatgtgaccatagaacctctcagactccataatcatgtgagccaattctctataataaattatatatataaatgatatgtatattatattatatatctattactatatataattttatatgtaagtatatattagctacatattttaaattatgtgtataatgagatatttatttatttatttatttatacatatcctgttagttctgtttctctggagaactctaacacaaggagagaatcttggtttttagttaggtgaagcagcttgattagactaacccccctactgataacaactataaactaaggaaataataaagaaaacaatcatggaagtcattggagaatgaccaaaagcagaacctagagagggtatcacccttatcaagaaggaaacacactaggaggagatccacaagcaatacttatattttccctcaggttgctactagtcttgtggctcacgaagggatagagctcaaacaaaaagaagaaactctattgatctgggaagtatttttcttttttcttttcctttttctttctttctttctttctttctttctttctttttttttttttagttcagcgccactagaacagtgggaaactagtaagggaacacctcagaaagatgcagctacagaagcagcaactgcaaatatgcacacaaattcccctcaaatcctgaattgaccctgaattgcacatagataaggcaaggtttcagggacactagcagaaggatacaggtggaaggtttaaagaactttccgagatttcagtagctgcccattactggacagacagagattggagttggagtcttgtcaagttagaaaggcttagtaaataccttgcattttcacttgacaccaaactctatatccagtggcaaaagcaaaacagaagtagacttatcccaacaaaggcccaaaccaagtttccacccataattaaactgctcactagaataaaacaaatcatccttcataaaagactttttaaaatgaaaagataaaaaatgggcaaagagatgggtacatttttggaaaaggtacaaactgtaaatgaactacatggaaatcctagacttgaaaaagaagcatgtgaaataagaaatttattggataagtttaccaacatatttagcacaacaaaagaaaggatatatgaggctgaatcacagaaagataaaaagaattaagacaaatgagcaaaccctcaatgacttgtggtataaaatctaaaatacatgtaatcagagtcccagaaatagaagataaagaaaaagggtaaaaagtcactttttcaatacatagatacaggaagatcagagcaccccaagcaagaaaaacatttaaaaatacaaaagaaaacaaaagaataaaaataggcaatttggaaccaatcttacataaaccaaagaaaagaaaagaatatcttaaaattggttgagggagggggaactattgcttactggggaacaacagtaagaatgacagcattaggagatcgaagataagaaaacaatttttaaagtgttataagaaaaaaaaatgttagcctaagatgatataaactgggaaattgtccttaagagatgaaagccaaataaatacatttgcagaaaaatcaaaatcttgagaatgtgttgcatatggatttgcgctccaagaaatgctacaggttcctcaagttgaatggaaatgataccagataaaactacagttgtccctcaatatccatgggaaattgtctccaggaccccctgggataccacaattcacagatgcttaattcctttatataacaagtgtattattgcatataacctacacattttctcttgtatacctcaaatcatctctaaattactaataatacctaatacaatgtaaatgctgtctaaatagttgttacactgtattgattaagggataatgacaagaaaaaaagtctatacagttcagaacagacccaacaatttttttcaaatattttccatctgcatgtatatgaatccacagatgcagaattcacagatgagaagggccaactgtacagatctctgagaagaaatttaataacgaatatgtgggtagtaataaatatttttttcttaaattctttggaagttaactcacagtttaaataaaaacagtaatttttttttggtgaggcttataatagatccaaagtaaaattcattataactatagcataatagacaggaagtgtgtaaatataataaattacaatgttgcaaggttcttactctttccacatattgcaagattcttactttttccacaaggtagtaaaatattaatccataggagtctgttgtgtgtgtgcattgtaatatctagagtaatctgtcgacaaaataatgtaatgaagggactctaaaaatcaaataggacaataaaatgaatcctaaacaatactctgctcaaaataagtcagtaaaaggaagaacaaagatcagagggtgcacatacataaaacttagcaagatagtgagtgataagctcaatcacatcaataagtgtattaaatgtaatgaataaaacactctaattatatttgtcaataaatcaatgtaaaaataatttagtttgcccagatcaagataatagattaaatacagacatttaatttctgctcatttcctgccttatataagcctactaaaattagagtaaaagtgttttatttttctttttgccccaaatggttttttgggtgttaatccctaaatcaaagagaatatgaaaggacacaatggcattaaagatatatatattttggaaagtgagaaaaaagaaagaagaataaattatcaatggcataagtcaagaagatgtcatagaactgaaggacatagacatgagctcccagatgtaaacagctcaccaagcaactagtacaatggttgtgaattaacccacatcattgtgaaatttcagagtgctgaaggcaaatagaaggtgctactggcttgcagagaggcaaaacaaaaacaaaaaacattttttatacaaaggtatggaggctagttgatggaagtttttttaagctagaagacagtggagcaagtcttcaaaattctaagcaaaaatgatttctaatctagagttccatactaatgcctaataattttacttctaatgtaacatttttaataagctactgaaaacagaatccaataatttaaacaacaacaaaaagtaaccaagaaggagaaatacaagaaatctaagaaatagggaatccattacaggatggaagttaaaggaatccacaggatgacggtagaggaaaagccaactcatattcatttgctacgtagcaggtcagaaatctcccaaagagatttttctttttttcaagaaaataatgggtagaatatttaataggatttaatctagtaagaataaaattgtgtacaccagttaaggaaggtttgggtttgaaataccaagagaacataaaatactaagacaaaaaaagtaatccatcagcaagggcaaatgaccagaccaagcatatgccatgtctgctaaaacggcaacaagccagtcttaacaatgaagctagttcgtgagggaaaatcatgaaaattatggagacaggagtggtagtcgggtttagtttacttattgttcatcacattcttggagaacacacagaaatctaatggagctggaagtcagattctgtgtgagagactttaaaattacataattagggaaaaatcatgcaatttaaaggatactgactcttactggtataagagactagcatccaacagcaacacaatatggaaaccaaccctattttataagcaacctatttatgtatggaaatcacctacctttctaaaatgttataggcatcctctgaggtggcccactaatgataggcacttcctgatgttcatattttttgtttaatctcccattctttgagtataggctggacttattgactcacttctaaggaatggaatgctgtggaatatcactttctaaactaggttataaaaagactgtggcttccatctttggttctccctctccctctgtcttgttcactccaggggaaaccaggttccatgtcatggggcagccctgtagatcagcccacatagttgaacttggaaacagattttctaaatcttaccaagagtcacatgtgtgaacttgtaagtgactctcccccaagtcaagttttgaaattactggactccttgatcacatcctgataagggagtaaatcatcaccctccagctcaactactcctccttatgactcactgtaactgtgaagtaataaatctttttgctttcagttgctatgtcctggggaaatttgttatgcagcaatagacagctaatacacctagtgggatcagaaagctgggcttcaggccttgtagttacagcttatatggtaaggtgaatggctgacccaatttaccccctcagctttctaccaaaattgattgccttaagcactcagttatgaccagttttcatagaattttatagaaggccaccttgcaaagaagtcttagacaaactaatctttgattctcagtttaaaccttctctgtgatcacaaaaggggacttcatagatcagaaagatctatagacatcagacgtatagatcagattagaatacactaacatgtcagcaacttgtagttgcaatgctagtcacaaatatgattatgataaactctggaggatggataacagaatacataggagaagaaacatttcaaaaaatacacttgaagctctcctctatgtcagactgtgggagctctgacctgactagagaaaaggtcccaacgttcttacttgggtgccttatacaaacatccttcctgttactctatttgggacaatgattctcccacttttccacttgttgatagcctctataaaacataatgctggtaaggatgtaacacttcttcattggccaatattgaaaagccattccattgtataaaactacccttgcaaaagaatcttagctagcccacggtgactccaagtcccagactatctaaatggccatttgacttagcttgatgtaaaaaaaatctatattatagtcagattaatcacccctacatggggataaaatataactgaggttgtggattattttgactttcactatcagtgccctttccttcagtaagataacttgtctgaaccacaggggccagaaaacaagccctggaaaactcgcagtggccagataatcaatttaaggcagcatattagagtctcctttggcagacaggggagcatcatgtatctacatagaaagaaccacatggaaggggcacattgtcccatccagagagtgccatttatagtcctagggtccagtcactggctgctctcatagatgttacattttagtgggtaagacagacaataaagcaaagaaccatttcaaagagctgtgagtgctatgaagaaaaaaacgggttatgggtagagagcaactgaagagggtatgtgggagatattaatagggttgccaagacaggtccctctaaaggaatgatatttgagctcagagctagtcatacaaaatcttggagaaaatattccagatggcaagcaagcaagttcacagtcaggaagaagtttggtatgtccctgaaacaggaagctactatgacttgaaagtaagtgggagagtgtgtgaaagagttccaagggcaaagggccatgtagagcctcgaatgtttgggtaaaatttttaattttaattttgcgtatgagctgaaaccactgggaaatttttagcagaaaaggaataggatctcattcaagtttttaaaaagatgtctttctgtcttggttgataattgattccagagcatgaagcaaaaaagtccaggctgaggtgggcagatcacaaggtcaggagatagagaccatcctggctaacacagtgaaaccccgtctctactaaaaataaaaaaaatattagctgggcgtggcagcgggcacctgtaatcccagctactggggaggctgaggcaggagaatggcgtgaacccgggaggtggagcttgcagtgagccgagattgcaccactgcactccagcctgggcaacagagcaagactccgtctcaaaaaaaaaaaagtccaatgagtagaccattgtggtagttcaaaccagagacgatggtggcttggaataaataagaacagtggcatgacaatctgtagactgggttcccaaatattttgggggaaaaactttaataacctgctgatagactggaaatgaggagagagagaaagcgaaaaatcgaaaaatgattctcaaagatttactttgagaaggagggagctggtagtagagaaggtgaaataaagcttactgtttttcatctatgcaatactgagatgctattagtcatctaaatgaagatgtcaagatgaggggtcagttgaggtgagaaaccgaataaaaattcagggcttgtgataaaaattagagacttaccagtgtatcagtggtgtgtaaaattgtagaagtagatgagattaataaagaaaaaaattcgttacaagaatcattggatagatttagggatcatggcagatgggaggcaggactagattgctccagacacagcagtatgcggaggctcgcattgtgaattttagcttcagatcgactgcaagaaaaaaccagaaatcccaagaggacccacagaccctctgaaggaagcggactactcctgcaggacccaggagacaccctaaatactgtgagtgccccaactgcagaagtgggaaagggagagcctcctctcccaaacacacacccccactggagaagctgaaggtctgtttgcgggagaagtttccgactttacttggagctgagtcaggttagagagccaagctgaacaaaatacaggggtagaggaagcagcagaaaagctctgggagcttgctgggtccccacgcagcctattgctgcctggcaccatagggatccatcaggagggtggccagagaagccgagggtaaaactccacaggcagaaggaattctctagctgacctttgtaacaatttgaacagagtgagaagcctcctggccagaacttgggagagggtgtgaatccggcttacagacttcacaggtggaggaagaactaaagcccttttctttcacaactgggaggtggaaagcctcaggcaagttttcaagcctgtctcaccctccacctggaaacagacttggggctgttgcagggggcatggtgggagtgagacaagcccctcgatttgcatgggagctgggtgaggcctgtgactgccagctttcccccacttccctgacaacctgcatgactcagcagaggcatccataatcttactaggtacacaagtccaatgacctgggaatctcatccccagcagccaaagcaagacccgcgcaagaagagtctgagctcagaaacacctagccccatccccacctgatggtcctcccctccccaccctggtagcagaagacaaagggcatataatcttgggagttctagggccctgcccaccactggtccttccccacactactacagctgatgctttctggaaagcaccacctcctggcaggaggccaagcagcacaaatatagagcattataccaccaaagctaaggaccctcatgaagtccattgcaccctacaccatctccactggaataggtgctggtattcacggctgagagactcatagacagttaacatcacaggactctgcctggagccaggtagacttgctgggtggcgagacccaaaagagagacaacaatcactgcagttcggctcacaggaagccacatccataggaaaagggggagagtactgcatcaagggaacaccccgtgagacaaaaaatatctgaacaacagccttgagccttagagtttccctctcacagaacctacccaaatgagaaggaactggaaaaccaaccctggtaatatgataaaacaaggctggtcaacaccccccacccccaaaatcacactaattcaccagcaatggatccaaatcaagaagaaatccctgatttacctgaaaaagaattcaggaggttagttattaagcaatcagggagggaccagagaaaggcaaagcccgaagcaaggaaacccaaaaaatgatacaagaagtgaagagagaaatattcaaggaaacagatagcttaaagaaaaaaacaataaaaaaattcaggaaactttggacacacttttagaaatgtgaaatgctctggtaagtctcagcaatataattgaacaagtagaagaaagaaattcagagctcgaagacaaggtctttgaattaacccaacccaacaaagacaaagagaaaagaataagaaaatatgaacaaagcctccaagaagtctgtgattatgttaaatgactaaacctgaaaataatcgttgtccctgagaaagaagacaattctaaaaccttggaaaacatatttgggggaataatcaacaaaaacttccccagtcttgctagagaactagacatgcaaatatgagaagcacaaagaacacctgggaaattcatcacaaaaagatcttcacctaggtatattgtcatcaggttatctaaagttaagacaaaggaaagaatcttaagagctgtgagacagaagcaccaggtaacctataaaggaaaacctatcagattaacacagatttctcagcagaaactctacaagctagaaaggattggggccttatcttcaaccttctcaaacaaaacaatttacagccaagaattttgtatccagtgaaactaagcatcatatatgaaggaaagatagtcattttaagacaaacaaatgctgagagaatttgccactgccaagccaccactacaagaactttaaaaggaactctaaatcttgaaacaaatcctggaaacacatcaaatcagaacctctttaaagcataaatcacacaggacctataaagccaaaatacaagttaaaaagcaaaaccaaaaccaaaaaaaaaattaaaaaaaaagtacacaggcaacaaagagcatgatgaatgcaatggtacctcacatttcaatactatcattgaatgtaaatggcctaaatgatccacttgaaagattcagaaccgcataatggataagaactcaccaaccaactatctggtaccttcaggagactcacctaacacataaggactcacataaacttcaagtaaaggggtgggaaaaaggcatttcatgcaaatggacaccaaaagtgactggggtggctattcttgtatcagacaaaacaaactttaaagcaaaaaatcccagcactttgggaggccgaggcgggtggaccatgaggtcaggagattgagaccatcctggctaacacggtgaaaccccgtctctactaaaaatacaaaaaaaaaaaaaattagccgggcatggtgacgggagcctgtagtcccagctgctcaggaggctgaggcaggagaatggcgtgaacccgggaggcggagcttgcagtgagccgagatcacgccactgcactccagcctgggcaacagagagagactccgtcaaaaaaaaaaaaaagcaacagcagttaaaagtgacaaaggaggacattatataatgctaaaagtccttatccaacaggaaaatatcacaatcctaagcatatatggacctaacactggagttcccaaatttgtaaaacagttactaatagacctaagaaatgagatagacagcaacacaataattgtgggggacttcggtattccactgagagcactagacaggtcatcaagacagaaagtcaacaaagaaacaatggatttaaattataccttgaaacaaatgggcttaacaaatatatacagaacatttcatccaacaaccgcagaatacacattctgttcaacagcacatggaactttctccaagatagaccatatgataagccataaaacaagcctcaatatatttaagaaaattgaaattatatcaagcactctctcagaccacagttgaacaaaactggaaatcaactccaaaaggaaccttcacaaccatgtaaatacatggaaattaaataacctgctcttgaatgagtattgggccaaaaacaaaatcaacatggaaattaaaaattatttgaactgaatgacaataatgacacaacctatgaaaacctctgggatacagctaaggtggtgctaagaggaaaattcatagcgctaaatgcctatatccagaagtctgaaagaatacaaacaaacagacaacctaaggccacacctcaaataactcgagaaacaagaacaaaacaaactcaaacccagcagaaaaaaggaaataaccaagatcagagcagagctaaatgaaattaaaataaaaaaatacaaaagataaatggaaaaaaagctggttatttgaaaagataaataaaattgatagaccattagcaagattaaccaagaaaagaagaaagaaaatccaaataaccgcactaagaaacaaaacagaagacattacatctgacaccactgaaatacaaaagatcattcaaggctactatgaacacctttaggcccataaactagaaagtctaaaagagatggataaattcctggaaaaatacaatgctccttgcttaaatcaggaagaattagataccctgaacagaccaacaaaaagcagtgagattgaaattgtaatttaaaaattaccaacaaaaaaaagtccaggaccagatggattcacagcagaattctaccagacattcaaagaagaattggtaccaatcgttttgacactatgccacaagagagagaaagaaggaaccctccctaattcattctatgaagccagcatcaccctaatactaaaaccaggaaaggacacaatcaaaaaagaaaactacagacagatatcgttgatgaacatagatgctaaaatccttaacaaaatactagccaaccaaatccaacaacatatcaagaagataattcaccatgatcaagtgggtttcatacaaggggtgcagagatggtttaacatacacaagtcaatacatgtgatacaccacataaacataatttttaaaaaaaatcacatgatcatctcaatagatgcagaaaaaacattcaacaaaatccagcatcctttatgattaaaaccctcagcaaaatcgacatacaagggacataccttaatgtaataaaggccatctattacaaatccacagccaacataatactgaatgggggaaacctgaaagcattccctctaagaatgggaacaagacaaggatgctcactctcaccactcctcttcaaaatagtactggaagtcctagccagagcaattacacaagagaaagaaataaaggacatccaaatcggtaaagaggaagtcaaactgtcactattggtgacgatatgatcgtttaccttgaaaaccctaagaactcctccaaaaagctcctagaactgataaaagaattcagcaatgtttctggatataagattaatgtacacaaatcagtagctcttctataccccaacagtgaccaagcatagaataaaatcaagaactcaactccttttacaatagctgcaaaaacaaacaaacaaacaaacaaacaaaaaaaacttaagaatataccaaacaaaggagttgaaagactgctgcaagggaaactacaaaacactgctgaaagaaatcatagatgacacaaacaaatggaaacgcatgccatgcccatgaatgggtagaatcaatattgtgaaaatgaccatactgccaaaagcaatctacaaattcaatgcaatccccatcaagataccaccatcattcttcacagagttagaaaaatcaattcaaaaattcatatggaaccaaaaaaaaaaaaagagcctgcatagccaaagcaagactaagcaaaaagaacaaatctagaggcatcacactgcctgatttcaaactatactataaagccatagtcaccaaaacagtgtggtactgatataaaaatgggcacatagaccaatgtaacagaatagagaacccagaaataaacccaaatacttagagccaactgatcttcaacaaagcaaacaaaaaataaagtggggaaaggacatccttttcaataaatggtgctgggatagttggctagccgcgtgtgggagaacgaaactggatcctcatctctcaccttatacaaatatcaactcaagatggattgaagacttaaacctaagacctgaaactataaaaattctagaagataacattagaaaaacccttctagacattgttttaggcaaggatttcgtgcccaagaacccaaaagcaaatgcaataaaaacaaagataaatagctgggacaaaactaaaagagtttttgcatggcaaaaaggaacagtcagcagagtaaacagacaacccacaaagtgggagaaaatcttcacaatctatacatctgacaaaggactaatatccagaatctacaacaaactcaaaaaacaaacaatcccatcaaaaagtgggctaagaacatgaatagaaaattctcaaaaaaagacatgcaaatggccaacaaacatatgaaaaaatgctcaacatcactaatgatcagggaaatgcaaatcaaaaccacagtgtgataccaccttactcctgcaagaatggccataatcaaaaaatcaaaaaacagtatatgttggtgtggatgaggtgatcagggaacacttctacactgctggtgggaatgcaaactagaacagccactatggaaaacagtgtggagattccttaaagaactaaaagtagaactaccatttgatccagcaattccactactgcatatctacccagaggaaaagaagtcattatttgaaaaagatacttgcacatgcatgtttatagcagcacaatttataattgcaaaattgtagaaccaacccaaatgcccatgaatcaatgaatggatgatgaaactgtggtatatatatacatgatggaatactactcagctataaaaaggaatgaattaacagcatttacagtgacctggatgagacaggagactattattttaagtgaagtaactcaggaatggaaaaccaaacattgtatattctcactgatatgtggaagataagctatgaggaagcaaaggcataagaatgatataatggactttggggacttggggggaagagtgggaggggggaaagtgataaaagacaacaaatatggtgcagtgtatacagctcaggtgatggatgcatcaaaatctcacaaagcaccactaaagaatttactcatgtaaccaaataccacctgtaccccaataaattatggaaaaataaaacaataaaaatttctaaaaaattaaagataaaaaaatgagatgatttctttttttaaagaatccttggacatttcagttaaggtaaaacaattcctggggttttcacatctgagtcattgagtcgtcaaagcaaaaagaggcctcctcagtaaacaatgtattaatatttaggtaactctgtctttgagaacctaaagtttccaaactcttcatttatgtaaacttactgagtgacaccaagtcagtgtagtttcctttatgtaggtgactagtattttctttaatattgtaattatcagaagagacaaaaggaattgctctgttaaatctgtatctaaagatggtggtatggaggcatggctttttaacataatggcttagtcttgttgattcattttagaaaagagattaccataaaatatgtggtaaattggagattctcaataacgactactttaaatattttctaaataagtattcacacgactcttttccattgaagctgttagtacctgttcattagtacctgtataaatgttctaacacaagcagctgtacaaccaatgctaaatgaaataaaaactgacacatttcagagaagtcttgtgttcttctcacctacttttgaagattgaagattattctgttttcttcttattatatcaaaagaggtatatttcctttcttttttctttctttccttttttttttttttttttttttgcagagaaaactccaagtattttttgcaaggaaaagttgatgatactgatgatgatggtgatggtgatggtggtactgattagagtgctgatggtagtagtcctggtgagtgttggtgatcatagctaatcatcactgagatactactgtatttcaagtgctgagataggagcttaaactgtgttctcacaacacaacaaaatgcaaattatttactttttttgcagattaacaaaatgaagatgaaacacagtaaattactttttcaaattacttgactggtaaggctaggatccacatcttggtctatttaacgccaaagcatttattcccttacactttttcatcctgtgcatcaatctattagagttcttgtctttatgttagtcatactcttatgtttaaaagcaaatgaagataatttctaagtcaaatgtgtgtgtacgtgtgtttacatttctaaggatactgagacaattgctatacaaaatccaaaggaaatatggcttcacaaattgtagtagatgtcccaactgtattccctgagatctcaccattgtaaggaactactgggcttccaactgcctgaaggtaccacaacatcagatcagaaagtgttaaaatatattctaccccccaccccatgcccagtatctctcaaccaatgttagatttagtatgcaaatccttagctcctttgcccctggtctgagctaactcttaggcacttgtcatatatgaccccagagttcccacttgaaattgccatttaccttgccgtactggtaactggcttgaaaatatactctttattttgtgccttttcttttctgcctcagttctccactctcctaacaatgcttcctgggatctccggccaagtaaaccagtacttttcaaaccctagcctcagggtctacttctaaaagaactcaaattaatctttctcatgtatgtccatgtttttattctggcttgaaaattttgggttacctattgagattgtacagcaaagaaaatatttgagcagattgcaggcagtattatatccaccatggtactctcccttcatttttaatgaaatagagtttcaactatgttcactgcattctcaatccctagttactagagctgagacagctttgcctttaaactaaaggttatttggatttttgggccacgaacagtgcaatgcttggaacttcctatatttatctggtgcaaagtcctttatgtgtggtaaacaagagtctagggctctatggactctcacttttcatcatagttgttatagcactcctgacctcagcctagaattgtgagaatacagggctgctcccaaacaagtgaggctgagttattttgtttacttgacacttttgatagaagagagaggtttcattctaaaggactcattcctgtagaaatttgatttacagacataccccagatatattgtaagttcaggtccagaccaccacaataaagtgaatatcacaataaagtgactgacacaaaatttttggtttcccaatgcatataaaagttatttttacaccacgctgtagtctactaggtatacaatgacattacatataaaaaatacatatcttaatttaaaaatcctttattactaagaaatgctaacaatcatctgagccttcagctaattataatctttttgctggtggagggtctttcttcaatgttgatggctcctgggtaatctgggtgatagatactcaaggttgggtggttgtggcaatttctgaaaataaggcaacagtgaagcttgtcacattaattgacccttcctttcatgaagattctctgtgcatgtgatactgttcaatagcattttatcagcactaaaacttctttcaaaattggaggcaattttctcaaaacctgccactgctttaccaactgagtttatgtaatagtctaaattctttgttgtcacttcaacaacatacacagcattttcaccaggagcagattccatctcaagaaacactttcattgctcatccataagaagcaacttgtcatccagtcaagttttatcatgagattgcagcaattcagtcatttcttccagctccacttctaattctagttctcttgctgtttccaccacaactacagtgacgtcctccactaagtcattcatagagattgaaattaacttcttccaaattctggttaatgttgatattttgacctctgcccatgagtcttaaatgttcttaatggcatcaagaatcataaatttttttccagaatattttcaattggctttgcccaggtacattagaggaatcactaactatgacagctgtaccattgcaaagtgtatttcttaaagaataagacttgaaattcaaaattactccttgatccatgggctacagaatacatgttgtgtcagcaagcatgaaaacaacattcattttattgtacatctccatcagagcttgtggatgatgaggtgccttacctttaagaaataatatttttaaaggaattcttttttctgagtagtaggtctcaacagtgggcttaaaatattcagtaaaccatcatgtaaacagatccaggctttgctgttccatctatagagcacaggaaggtagatttggcataataataaggaccctaatatttttgggatggtaaataagcattggcttcaactttaagtcaccagctgcattagctcctaacaagagaatcagcctgtcctttgaaggatttgaaaccaggcattgactcctctctaacaatgaaagtgccagatggcatcatcttccaatagaaggctacttcgtctatattgaaaatcagttgtttagtgtagccacctccatcaatatctcagctagatcttctggataacttgcagcttctataatctgcacttgcagctttaccttgtatttttaagtaatgaagatgacttttttttcctgaaaactcatcaaccaacctctgcttgtttcaaactttttcttctatagcttcctcacttctctcagccttcattgaagattaaaggctttctctaatcatcaaccaacctctgcttgtttcaaactttttcttctatagcttcctcacttctatcagccttcattgaagattaaaggctttctctaaattagactttggcttgaggaaatgttatggatggtttgatctttctagaccactaaagcttttttccatatcggcagtaaggttattttcttacaatttgtgaataccctggagtagcacttttaattttcttttcctctgcattcataactgggctaacagtttggctcaagaggcctatctttcagcctttctgggcttttgacatacctctctcactaagcttaatcatttatatcttttgattaaaagtgaaagacgtgtaactactcctttcatttgaacacttagagaccattgtacggttattaattgtcctaatttcaatattgttgcacctcaggaaataaggaagcctaagaaggagaagagagatagggaaacagccagtgggtggagctgtcagaacacatacaacatttatcattttagttcactgtcttatgtgagcatggtttgtggcaccccaaaacaatcacaataggaacatcaaaaatcagtgaaaacagattaccataatggatataataataatgaaaaagtgaaatattgtgagagttaccaaaatgtgacaaaggggcaggaagtaagcacttgcttttggcaaagtgatactgatagacttgctggatacagtttctgcacaccttcaatttgcaaaaattgcagtatctatgaagtgtaataaagtgaagtgcaataaggtgaggtatgcctgtacacagtgtagcacttagatgtaattctgaatgattctggcttaccttcactcacatttctttattccataaaatttttaactcattttatcatttgttttataagatagctaataggatattcattaacttatttacagtagtggacaatggtttgtttatagtaagctcattttttgctgctgtataattaaacattttttttctgaatttaacttaccctgaaggcattattggagaaaatgcatctacagtatttacatttgtaactcctttttaaatttactagcacagggaaattttattctttttaacacatcttgggtttggttctttgtctctggatcaaatagagatcacaattactagactatttaatgtcccatatgaatttctcaggctccttactctctgagaattcatctgcacaatttaaccacaggaagaaataaacatttctttggatttatgagaagtaaaatattcaaacctcaactgaagaaacattcatatcatctgggtatgttcaagaaaaaaaaatgtaagccagaccatccaacaacacattaaaagagatagtcatttctctcatcttggggctggaaatttcttttccaactgacgtttccaacatgtgaaatatagctgccatcacattaaccagatatacagcactctgagctgaaagcataaattgtacacatcttgctcccagtagctgtgaaaaggaaacgtaggtgcaaggtcaacaagaacccctcctatagaagaagtctgcaaattgagaggggaatgggagatcctgctattgctgggatggtcctgttttttgtcaagctatgtcatgggaccaagaggctcaggaaatgagcaggaagattttgttctggatgaaaaggactacttcatgtagtctttgacatactttgaaagggaggatggaataagggagaaacagcatcacatttaatgcctggctttaccatttaccagctgtgcaaccatttaaacacttgagcaacaatttaaacacttgacccttggttttctcaactgtgctgtagaggataatcattacttctttaacctacccctacagagattttgtagggaatagatggcatgatgtatgggaaagcacattgtgtattgtaaaactgtaagcatgcagtaattataacgatttacttttattgaccctgtagtgcatgctagatattcttctcagggtttcatatagtacctcattaaatcctcatggcgaactttgaaaaaggtactattattattttcattgtacatttcagtaacttgaacaaggttacaggacaagtagaatatggcagagatggaatttgaactcaagcaatcaaattcaaaagactatactctaaagcaatggcactcagggagtgatccatcagtgcctgtgcacaacaaggtaagtgcagaaattgagcacaagtgtttgaaaacttatgtagctttttgatattgtctcaatgtcaatatgtgatcatttttatagtaatctgtgttaattgtcatttatgaaatattggtccacaatggattgaaaagaataagaactcatatttcatcacagatggttctaaaagcattgttctgaaacactacactataaggttgtaattgattttgttattggaatatcatgggcaacttgtaagacagacttgctaagagaattagaagctttataaataactatatctaattgaatattcttatgaatattataaagataaacaataatttattaaactaaaatcaggtttttgagatcagtactccgggtctggccaaatttctccactttctttccctctttttcctgctctgtactttagacacagtactaccagaatagtagtttttttacaaaacaaatattctataatatataaatagtattgggggagcacaggggagtttgatctctaggagaaagagacttgcactggccacaatcgcaaatatcccccaaataaaaaaggggggaaatgaacaactgttattagaaagtttgtatctaatcaatcatggaataaatgaaaaacatctttattacacctgagattttatagcaatgcttagaaatatattgaaattccatttttctccatgagacagtttctaggtctgacttgtttagaataaatgtttgattcttttactttcactgaaatcttcttatatatcaaacttatttcatttgctcaaagaattgccattttctcttctgcattttttttcattcaaatcccacctcaaaggaagaaattctgataaaataagaaattcctagagattattttaatatctattctgggttacatatgaaacccattgttcaaggcttgtggagcacttacataaaaaccagtttcagtcagaaattgatcataagcatcgttgtgcaaagaatataatatccaatttggtgagaagaacaaatgaacatataagcttgaattaaaaataaatataaaatttaaaacgtaagttacatttggaaattttggtccaagaataaatgtctccatgaaagatatagaaaggaggttgatttttttttttgaaacattgggatttatttatctttctcttctaaagatatatagtttctttttagcacaacagtcaagacagcaccttgggctctcagagatggtaaattctactctcagttgctccattaactcaatatatgaccttggaagtttctctaagtcccttggtgcctcagtttccttttctatcaaatacatatgtctgaaataactaaatcacttcacactgcctttaaggaaaaaataaaacaggaaaagagaagagaataaaatatctgagatcaaagaaagttggcatctaaatgccacatatcaattgaattgtaacatgtatgaaacttaaatgggagtaaataacagtaacaaaaatgagttgaattttaatatgtattaaacttcaatgggagtaaataacagtaacttaaatgggagtaagtaatggtaactattatagattattgtaaagtacttaacagggggctctggcacatagtaagcctcagtaaactttagattttactcttgttttcattatcattcctattatgataaaaatcaagagtcagggtagcagagtgtgagtgtagtggggaagaggatttactctaggaagtagacctcgtagaactgaaggaggagctagaggagttcaagtttggaaagggaattggaggattggagaaagggttgtcaatcagtcaatctatgaaccaaggccatcaattcatcaaaactaatattgccagacccaacaaattaaaaagtacaggatgctcagttcaattagaattttaaataaattctttttttttttttttggatgactatgtccctgcagtggaggactatgtctttgaagataaaatgccacgattaattctctaacacattcaggattgtctttactaggagataatagattattaccaatatttcactgctataattaactcttgcattatttgggacatacttatacaaaaatatttattgtttatctgaaattacaatttaaataaatgttttatattttacctgttaaccttagactatgaaaggaaagttcttagggagactcatgggaagtttatcttctctgtccttgtctcaccactgtaggtccacaacctggcatttagtggtaggcctggagctgctcttggtcaacagtgtcagaagttgggaagaagagctgcatatcaagcagaagagaatgagaagaaacaggaacccacttctgcatctgtctatagcaacatctgactataacgaccttcaaaagataatggctgttgcttcatttccaaccctccaaatctcaagcaagtatatctttgggccaactgtaacctataactctatagggaagaggtttctgagaactctgtgtcacagcttaaccatacgaagacaatacaaaccatcccgatgatgatgatggttggtaataatgaagaaaataatatgagtgttttctcaaggaaggctacttcttgatggcagttctgggagacataagagaagttttatttttacccaaatggttggtaaataaattactgtgtgacatgacagagttcaagttatatgatatagtagattcacattatgccaaaaactataagcctcccagacacagcccaggaattcattttgagagctatcataggcttctgaatgtgctaccatctatgctcttaatttaaaccttaatttgctgtgtggacgacagactactctgaaaaaaaccccaaatgcttcagtgcaggactatgtgtcgtggataaagtaacaaaattacatattcaacccattatggccatcctcttgtatgggagatgcagattgttaccaatatttaactcttataattaacttgaataaatttccttacaaaataaatatgtacacttgtaaatattccattatagtatctttcttagtgtagatatcctggagtaaaagcaaaatatttacaaaacaaggtaacaatttttaaagcaaaatatctattatcaaattgttctccagataggtattaccaattacacacccaccagcccagcagtgtgaaaatatcacatctcccacacccccatccacacccacgtggaaaattattattaaaaattaatttttaccaacttgagagggaaatggtcttattttaattttttcaggggtggattcatatgtttactagatatgtatatgtatccttctatgagatacttgttaggttatttcccatttctctgttgtggcattaatttctttttcttgttaataatgctcccgaagttttatgtcagtcttttcatttgtttatagtattttatggcaaaggattttcttaattaagtggttgtagtcaaatctgctagtttttatctttgttttcagtttgcaatgtcatgtatagacatggctatctaccaccaaaagtattttaaaaagcaatgtgtaggttttctacttttgaagaatgtgcattttctacttttgaagtatgtgcattttctaccaaagtctttggtttgtttgatatgtgcaatgaagaaaaatatctaacaataccttaagttttctcaaataatattccaattatcctaatatcctttgtgacttaaacttcctattctgacttaaaaagacttttatcataagtgctctacttaatcatagccttagcacatagtgtgagtcctagagtcagactacaaggtaattactgtcacttacaagctgtgtgaccttaagtgatttaatttaatcatcctgtgactaagttttctaatctgtaaaattggaataatgtgaggataaaattatcataaggattagcaagctgaattaacacgtgtaaagctcatagacgactgccgggcacatagtgaatactcaggaaatattactggttgttgtgtagcaagatgtacaatgaaacactggtacaatttcagattttgggttttgaggaccgggcttagagggtcaccttggagagaatcttgtagagtcccacatctaccctctgcctcaatgagatacgatcctccactttgatgagatattaccacttagagaacttgctacatgtcaatccctgctatggagaaagtagacttttaatctaatgcagtagacttgaaatcattcgaatgtgagagaagagctggagtcagaaagaggtaaaaagagggcctgagactatgccttaaattgttaatatatttaagggatagaagaaagaacaggagaactgttagagaagatagaaagaaattgtttcctggatcaaaaacagttctagactggactgtgtctcccacccctttaaattcatgtgttgaagctctagccctcaatgggactgtatttggagataagacctttaaagatgtaattaaagttaaatgaggtcataagagtagggccctaatccaataaagcctgtgttcttataagaagaggaagagacttcaaggatgcctggaaaggccatgtgaggacacagctgggcaggggccatctgcaagccaagaagagagccctcaggagaaaccacacttgctgacacctggatctttgctctccaacctccagaattgtaagaaataaatttctgttgttctagccacccagtctgtgggattttgttatggcagccctggcagactaatataggatccaagagaagagagagtttgaaaaaggagggagtgattgattgtgagaagtgctgctgaaaacataacaataaagtaagctgagaacttaagtgtctgttggatcaggaaataagaagtcattgttaattttgacaagaacattttaatggactgatagaggcagattgcagcggattgaagactaaagagcaggattcacatagaaaatatggcaatatttcaaatcatcaaaatgacaatatggctgagtaggcgttgtataatgaataaagaacttcataattaaatgcttattcgcaacttttagtctgaacatcttttgctgtaggagatcttgccaaattgattcccttcgtacttcccagtccaaatctaaattagtcactgctattacatatatgttaccttatcatttttaaattgtagtctgtatcatagttacttatacttctgcagttacttaattttctctctcacgaggcagtaagcaatgtgagaacaaggatcatatttggtttattccattatctatggttagaacatagtggacatttaatatgcattaaataaaactaaaattcattcaacaatatgtcattaaaatctttacatgtcaaatatatcattttactgactggattttatgtatacatgtaatttacaccagcctttcctactataaattatactatctggaattgtttagccagttaaggattaaattctgcataaaatttaacttttttcttttttctccagaaaaactgttttgaccctgggctttttttgcaagtagttttctaattttctaaataattttttggcctgtcatggtagctcatgcctacaatcccagcactttgtaaggcagaggtgagaggatggcttgaggccaggagtttgagaccagcctggacaacatagtgagacctaactctatatattaaaaatacaaataaaaacattagcagggcatggtggtgcacgtgagcatgagacgtcgaggctgcagtgagcagtgattgcgccactgcactccagcctgtgcaacagagtgaaactctgtctcgaaagaaaaagaaaaaaaattttcatggtaattgccttattcaagtttccagctctagttgtacatagcattctcatttttaatctgtgttaagtaattatttcatattcttaattctaactttgatggcttttttcctttaaaaaaactttattgaagtataatttacatataataaaatgcacctattaatttgtacagtttgatgagctttcacaaatgccaccaccataaacaagatatagaacacttccatcactcagagaagtacactcatgcccctttgcagacaatcacttctacctctgcccaaggcaaccactgatatactttgtcaatttagatgaagatctcatataaattgaatcatatggcacatattcagcagaacatggtgtcacaggaattcatccatgtagttgtatgtatcagtagttgatgcctttttattgctgcatagtatctttccaataaaacattttattcttttcaaagaataaaaaaattctttacaaacaattgcttatccattcacaagatgataaatatttaggttatcatcaggtgcttgagttttctattgctattgtaacaaataaacacaaacttgatgggatacaacgatacaaatttatcatcttatagctctggagataaaaagtccaaaataagtttcatggtactaaaatcaagatgtggcaggactccgtttcttctggatgtttagaggcagtgttttctttctttttccagcttctagaggttcccacattccttggctcctaggctcctttcatcttcaaagccaacacatctttctcatagcttcttatctctgacttgacaatgtctcttttttgctcataggtagccttgtgattacattgggcttacccagatccaggtcatctaggataatctctctacccaagatctttaacgtaatcacacctgcaaagtcccttttgcgaagaaaggtaatatattcatagtttctggagattaggcctttccaggcaaagaggtggaaatctttgtggggccatttttctgcctcctacacaaggtaaaggatattatgagtgaagctatggtgaacacgcatgaacaagtctcttgtgaacataggtttttatttcatttagtggtggaagtgctgagctggatggcaaatatatgtttagctttatgataaactgccaaatagttttccaaaatggttgctccatgttacatgctcactaacactatttgagatttcattgactccttatctttttcaatactcaatattgtcaaactttcaaattttagccatttagtgggtaaggagtagtgtctcaactgtggttttaatttgtattttcttgatgactaatatgttgagcatcttttcccatgataactgattacacatatatatttttgtgtgaagtatgtgttcaacatttatgcccattttcattgttttttgttgtcttgttaaattgtaagaaatgtgtgtgtgtgtgtgtgtgtgtgtaacaagtgttttttgagatatatatattttgaatattgcctcaaagtcttgggtttctctttttcttaactaaatatctttctatgagcaaaactttaaacatttggtgtaatttaatttttcatttttttctattattgttagtgagtatattgcgtaggataccatcatgatgatgattttttcctaccctcccacaatctgttttgtattttagcttttacatttagtcctgtgatccattctgagtcagtttttgtgtacggcctgaggtaagggtgaaggcccatttcttttccatagtaatacccagttgtttcagcactatttattgaaattactatatttctgttattgatatgcattggcaactctgtagaaaattaattatagtattgtacttagcattttaataatattttaaatccttttgttaagtatgtattgcttatattttctctttatatgtttcttttgactgtctttctaatacataactatttaataaacatgtcaaaatcagctggatttttcactatttttaaatcttggatttataagtcaattctataatttttctctcttgcaattatgcaagggattatgggaattgattataaacctgttatgaaaaatattagaatttaataagagagaaattgaaagataatatataaaagtctgtaattgcctatgttcaaataatcaccatcagaatacagaatattaaaaaatgtatgttgtttaaaaaacaacggaaagtggtaaaatagatataaattttacaagtattgcatcagacataatttaaaaagctataaagaagtataaatgaggattcaaataactgaaaatctatcctatgcctttgaataggaagatataattgcatcattatgtcactgttcactaaactcatatatatattcaatgcaatcctaattaacaaaccaagaggattttgttgtcatttacatgcttttcaccttgtagtttttagatttatatttgatttttgtacctgtaggaaactaaacaatttatattaaattcaccttgaaaataaatatgtagaggctaggacgttttctaataatggagaaaattagaaaaatctaataatgggggcagacagtcatagaatttaaaaatatattattaaataaaataatttttaaaaccttagcactagaaatgaatatatttataatggcaccagaaatgagttagaccaaacaataaaacagagtaaaggataaagaaagagacacacacgattggctttagtttatggtaatgatggcactgtaaattagtagggaagatagggataattctataaatcatattaaataaatgtaaagataagtcatcattctttaaaacaagataaatttttgatggaacaaagatttaaagcaagcataaaatttctagaaagaaagcactgtgcattgatttataatactgaaatgagaaagatctttctaaattagacatgaaaactaaacacctttacaaagatttgataacattgactacattaaaacaaacggacaaaaacttaccataaacaaagtcaaaaggcccacaagaaactggaaaagaattttgcaatatatgcaacagacacaaaacaaattttcaaaattttcaaaatgcatatataaaatcttgaagaaaaatctgcaagagctataaacaggcagtatagagaaaaatataatgaaatgtgcaataaatgtctgatgagatatggaaccccactcacaattatataaaataattaactcattcaacaaatttattgagtatttcttccatgttgggaaaacagccattaacaaaataaacccaaatctcagctctaatgctgcttacattctagtaagcaaataatagacaataaacaagataaatgaatacaatataatttattagatgaggactgagtgctgtggagaaaataaagcagagaaaggagaaaggaagttctaaggggagggaggagtgctgcaattttctatatgatacccaggcacgacctccaataaaggtaacaatggggtacatttcacaatttcacacctaatggaaatgtgtgtgtgtgctgcaaaatatatgttcaagaatgtttatagtatcattatttgtaacagcaacaactggaaacaaccatatctatcaagtctatcaatactagaataaataaatattttggtatattcacacaatgaaatcgcatgcaacaataaatctgaatgtgctacaattacaagagaacaatacgttggaatctcaagaacatatttgaaagtgaggaattcatatttcagagccttcactgtgtggctccatttagatcaaggttaaaactaggcaaaactaaaaataagtttagaagttaggatagcagttacctttgagtaggagagagatcgtaataattacactgtgcatgaggatgtctttagtttactaagagtgttctatttcttggcctgagtaatggtcacacaattgttttctcatgggacaattcattgagctgtgcaattgcaattgcaatttatgcacttttctttatgtctgttacatgtcagtttgaaaaaaaaataaaaagagtgatttaattttctttttctggatgcctaagattctttcattattcttgacgtttaaaaactgaaccagccatttttatcttttcattaacttttcctgctactcagtgaacactttgatctgtatacttgggcctttcacaggtcagagaagcttcttcatgttttccctcttttctttaataagaaatattacacttcattggctctcttgtctctggtcttcaatttctaccatattcgttcctattgtctttgtgtctgaatatttctgctgcactttaagagtaattaccatttgtctttcaaattatttatttgattttcagaattatcaattcacttctgaactttttactgctagtaattttctttctgaaattgctttttagtttcctaatatggtagtcattgaggctgttcacatgtttttagctttgttttgttttgttttttaggttgtagagaaggtactgttcccattgaaatcagtaacggccatgtgacctgatttgactcatgaaatgtaagtggaagatgaatgtagactttatgtgcagaggctttaagagttatgagataattgtcatactctcgttcataatctttgtacctcagtgattagcaacactcactgtcatgacttcttcatcatcctgggtcctagagtgaagtcctagagcccattatcaactcatgctaaatatgtaggataagcaagaaataagatcttcctgcttgaagccactgatattttggactttttgttactgcagcaacatcatgcctagcctgactgatacatggtatataatcattcctaatattttcctaatatttgtaatttatacaatttcatttgtttgcttactatcataattatataattatacaatagttacttatacaattttatctgtttactgtcataattattccaaaaattgtgaccagtttcttcatattaattgccatcatctcttttcttacagtgtggactttttcatagtctcaatgggatgtttatctaaaatgcatacattcctaaatgaagagtgcccttgtcttcactgtatattgtgttattgttagaactttcaaacatgctaaagaagctgataagtctaagttcacatcaacaattacattattcaacgacctgagagaagtgaagccaggttgagtgtagtcccagtagagagatgttttctgtgttctctttcttttgtgtttagtaaaggtacttcaccagaggtcaattttctgtaccaatttctgtttggctggagcagattccagctgtgtctgtgcttggtctcccacctgatgccaccacatcaaagggaagcccatattacactggaaacaaggccctgcttccctgctgagttttgtgttttgtgacgttcccaagcaaaattcgaaatcttcctgtttcaatttttgtaatgtttatcattaaaataatactctcacatgtgaataaatcaaatactaagattagcctatcctaatttctatacctcctacccccatacgtgtttaaacctgtagtcccactctccaggagaaacctctttttttttaattggtaatataggtgttaatttttgatattttaaatatctcaaataaagaaaaagaaagaaataaagtaaaattacttgttaaaaatcagttcaaattaaaattcactataatggttaaaacagctaacatgtattgaatgattatgctctaggcactgtggaaaaacctctttaacatgtccctgttacctccaacatactaaataataaacttacatctctgtaactttatttaaacactccggacaggtattgattgattgcctacaatttttttaaaaagttttgctaagtaaacctttaacccactccacttctcttctccatgcttaatagaaccatttcttgcaattcttcaatttgtcgttagattatatttaatatttcaaatattagtgtgcttacatttgcttccacattccctctaccatttcacttcccactgtctgtgtgctattcttttacatttataccagattttttttggttaatatattcatttagttctgcatcaccatctaagttcttacacaatttttccatgagttaagcaaagttgaaaaccattacaacattattacattattatgttattatgaatgtgtgcttgttatatttcctttcgtatatgaataatacaaaaactcctaagccacctagaagagaatgttaggagcaccaaggcaaagacaaattctcttatattccaacaattgcttcaaatcaattgtttatatgtaacttatttttttcctcaaatttcatattgccattcattttcttttgaatcacatgctttatcatacctccactttgtgccatcccctcaatcacagagtcccctgcatgacatcttcttttctcttcattggtctccctcccagagcccagcattctcctatggcactctaaaacgaccaccttaaagccggatggaccactgtcatcctgagattcccctgtattgctctgcttctttgtccttgtgtttttgtatttcttggtcttctccttcattttgctagagtacaccctcagatttttacatttaccaaaatgtaaagagattcgggaggtgtggctgcttgtttcatgacgtgggacctagttatcttctcctcaacatcctttctccttttcttactaaggaacagaatttgattttttttttcttgggctgcaaagtgcccaaataaagatgcaaccttgcagctaggtatgttcaataatttaaggaggcattgttgggtgcaatttcagggaacacttctttgatgggttaaaatacctggtaagcgctccatagacaagcatgcacctacttctaactggaacgcagatgtgataagaggaactccaacagccatttgaaacatgaggtaatcttgtgaacagaagccatgcactaaggataacaaagagaggagccaggcactaagaagtctgggaagctgatgacatcataaaactgctatactagccctgttacactatattgtacttaaaacatagctgccacttacttaaaaatatattttacaagggaaagagaaaaatttatatgcaatttaagtaacttatttctgatctcagttgctagctactgaatgcaattacatattgaaaatggtgataaaatttctgggctcttaaacatctaaaaatacctcaattctgccctcatgctaactatttttgtgattacagatttcaaggttgaaaattactttccctctatgctgtagccatttctctgttctcttctagcattaattgttgctgtcgagaatctgatgcaagtttgattttcatttctttgtgggaaattgttttctcctctttaaaaagtttggaatctttacgattttcttgatgttttaaaactttacaagaatgtatccagatgtgggtttcgttttcatttccattctttgtacaaggcactcagtaatatatgacctaaagatttatgttctgtaactcaaagaaagtgtctcctattatttcttggataatgttcgcccttccattttctttgttctgtatgtctacttgtcagttactggacctctgcatttgtttattaggttccatcctttcctttatgtttttggttctacttttatttctttacattctggaagatttcctgtatatttgaagcagctttcttgactttttaaaattttagcaattctatttttaatgtctaacatcccattaaatgttagtaattctatttttaatgtctaacatcccattcttacattatagtagttacttttcatagcatcctatcataattttatggaacacaatatcttctcaaatatctgtgtgaatattaattaaaggtattatattttggtgtttattgacattaaaatattttctactccttgtttactctgggaaaacttttaaaaatctttgttcttaaatttttatatgtgtcttataatctttgatgatttttacacgaataggactaggtaaccacgtgggtattttctgcatctgtaaggagctaattttctcactatgtctcaccttgtttctccctgagcagaaggtccagccaggagggtgggaagtgtgagaatggtatagtgcacgcagacattgggtccccaaattacagaatgaggagggtcaccaacaccacacttaaaagacttgacttttctggatggctactttaattttggtatggaagagatttgactcgtggtaaataccagactgtcttcactccacaacacggatatgggagggagaaaagggtgccaataggagtagttattttgttgctctcttctatcatactcactaactatggggcagagtctctctgggattcactgcatcagttggtttccctcttctctgcagccatctttgtacaattgaccattcctttcctgtctttcaaaaatgtattgaaaaatctcatccatcaaaatttactacccaatcagttttcttcttttcttctctattatatatttaatccttttgtttttcattcttttatttttgtgaacagaagtacatcatgttgccctagattctatattcaaaggagctgattcatgccagtaaaacagaatccaagtggtatgttccctgagttctttctgtatctccagccctctcttttggtcaataagctttcattctatgtgacacagactcaacaaatagttattgatttacttcattaaaatattcagagttagacaaagttttcggcatgcctctaccccagggtttaatgttgtcagtctgtctgtctccccatctcttgaatcagtattcttttttgcctttactctcatgatgccactagcagctccaggcttacatcaatgcaggattaagtctagaagaagagttccccagaatacaagcaaatttgccattcttagtttatttgcattcctgttacagtctctgtggtgagaggattataatgttctctgcagtataaaggaactgcatctctaaaccatttctatcagccaaagggattcaatgctctgagtgcccactctaataccaggggtggtgttgctgacattgctagtttcattgaaaattcattttccctttcttcccttataaatataactcttggattttagttggcttcatggcttcatttcccatccttccttagagctagatgtatgctcatgggtgtattttgatccatagcatgtaagaagtgtatatgccatttcagggaggatggcagtgcaacaaaagtgatggaatttagatctggaataccaaagggcttattgccagtcctggtcactcatctatcttaatttacatgaaaaataaatttcaatctgtttcagctgtcttgggttttctgtaattcacagctaattatttttttcttttttctttttctttctttcttttttttttttaagatggtgtctcgctctgtcacccaggctggagtgcagtggtaccttcttggctcactgcaacctccacctcctgggttcaagtgattctcctgcctcagcctcctgagtagctgggactacaggcatgtgccaccacgcctgactaattttttctatttttagtagagatggggtttcaccttgttagccaggatgttctcaatctcctgaactcgtgatccgcccacctcatcctcccaaagtgctgggattataggcgtgagccaccgctcctggtcagctaacttttttttcaagtagagatactgtcagttccatcccaaccacacggacattgacaactgacataagtagctcaggaaaaaaaaaaatagtaataatcagaagttctaaatttactccaaatgtttggggcattattactggccaagtaaatgcaaaagatgaggatgcaatatatacagataaggtcacaaacggaggattcctggatgaacttttgttgaagcagttaccttacagtaggaggtattgtgtgttagtcctcaccgccagcatttttttgaccccatctacatgcacttagtagatagtccttgatgtgtctgccttaaggaaaccatccttctctagtttttagtgcatatgttggctttcacctattttaatactgtttgtcattataaattgaattttagcccctaccctcacccttacctggaagtctataaaacattttctcataaacttttgtaacacaattcaattattaaaaccaattatactgtttaaaataaaagcctttagaaggcttgtcagctacttgatatatataatatttaaaggaacttcttccctttttagtttctttagagtataattagtttctctagaaaatgcctggatttttggaaaaggaaactacaagtaatttttttaaaaccaatatccctattcagacaaccaaaatgaaaactcctctctagcatttggatttatcttttttaaagaaatgtgtttcttgtattatgataaatcctgaaatttaaaatgtccattaaataagaaacaccttatgaagacaaacctgaaaatagactgcgactagcaattaagaaagcaggaattgacacccagctatcttgctcaccactatgtgaccatgaaagagttattggtggacttgagatgtttcacagccacgtccctttttgtcatggtaagaatcaagctgtcccagtcatctatccctatccgtgtgcaaacctccatattcctctgagtttcttttcttcaaacctccaatcttagctctctcttccactttaactttttcctatgagatctctgatctaaagaaaataaattctcctacatgctcagtttccacaagcctctctcttcaccttcttccttcagccctcctccacccctcccataacaatgccacctccccgcacacgtgcgcatcttctccctcattccaagtttgttctttgagctcatggatacatgattggctccctgattctctcctacccacccagtccctctattaggactattctttgtccttccatcttaacactcaaggtccataactctaatagatatgcaattgaaactgatattttcaatgcaggcactcctttgtttcatagaacttacctggaacacatcatctttcaaaaactctactaatatctgcctatgctaaaaactaaagaaggaaattatatctgcataaattcatgccattaaatctttaaggtttcaaactgcaaataagtttgaatcctttccaatgaatctatccccttcctcccagtgtgtatatcacatcataataattcaagtcttgaatcccatgactcctccatctcctttaggagaaaatgaaggctgcagtataggaactagacttattctctgcccttgaccctacggagtcagttgcatctgcaaacaacttcctcctcttcgtccatcacagaagtagtatccacatttccacgtaaggtggcatcctgggtcctgcttcttcctgaatccttgaagatttgaatctatcacttattatcccctctagtatttccaatatctccttatatcctggtctttcttgtgattgtctaaacatattcaaggctcacctatattagaacaaataaacaaacttctcctgaccctgtgtgcttatccctctactgtcttttctctccttccactgatacactaatttctttgaagtgatgcctgcactcactgttgccaccttcttattctccaggtatctttaactcactgatctatcctttcaccaaaactgttctcaccagggtcatcagtggtctctgctgttaaatccagttatttatttttttttctttcttgacttctgcagcatttgaaatgataaattatttcctccttcttgagactctgctcctcatgccacttgataccataatttcacattttctaataattctcttgcatctattgctcagatttttataaagacatctctccttcaatagttatacctctgattttgtagcccatgttcctgtctttatttttttctcttctaactctgaactgttggtttctaaccatttcaggaatccgttaaaagccaagaatatgtcaggaaaacaaacatatgcgatgatttgtttataaaatgtcagagtttttatcaactttctaaaagtcttccatggatcccacttcatgcattctctcacatgttcacattccctgtcatgttttcaggaaccactcatatgctatttattcactatcactgtctccagccatgactgccaccttcctacctagctctatttgaatgttctcccacatagctcgtcctcgttctgtccaaaatgaaacccaccagcttccttcctgtaaacttgattccacccttaccactggagcaaaaactccataagccaaaagatcttctctatcttttatggctttacttctaaacccagaggagtgcctggcacatgataggcacccaataaattttggctgaatggaggaatcaatgtgttttagctcaatagatggctctattatttaagcacttgacaaactataaacctgagtctgcttccttccccacaagcctgagtcattttgtctctagcttcttaatttcacttttttttttctgtagtgctataatggcctcctcactccctctgtccttacatcctctattccatgtgttttcaatattgctagagtaatctttctagagtgcaaatatgtttatgcccctttcttcttaatttttttccagaaattctgcatggcttttcagaaagttcaaatagcatagaacagaggcctataatggtcttgcttgtgctttccttccatctatccctcgctgcttttccctgatacagattctatgcctgaccttgctacaagaacaactaatcttgctttcctgaacctgtcttgttctcttcaacttcaggccattgctcatggctttctgcttggaatattaaatgtgtccgcctctctcgaagtcactgctcaggactcctgccatatgccctttccatggctgctcccttctcactctccagtctggaataaaactcttttctaaatgctttcatggtaccctgttctcacccttatcctaacacctgtcacattgtgatttaattgtttatgacagtcacgtcacctcattctctactaaagggtaactttcatcattgcaaaaactgtcttatttatgtttgcttcccttgtgtttagtacagtgctcaataaatagacacggagccaattaatcccatcgctatcagcttttgttctctatatggtccggttctcccagatgaaattttcaatattttggattcatttcacgcatttcactgccactttccaagtaagcctgggtcatggaagatttccctaatgcaggaaatgaatagaataaatgcgtacatagattgtatgccgtggtaattaaatcattagtgctgaacagtggtattgagactggaccatgttaacatatgtttttattcattagaagcaataagtaaagatgaaacctagtaattatagactgtgaatacaaaggagttatctgggtggtctatcataagtcttgaacaaaggaaagcaaaaggcaaacaccagtatttctccagacttccttagtaaatatgatactggcattctgatattctgtgctaattttaagaatcaaactggtagtatttttgtatgtgtaatgccattgtttcaggcattcattttcagttttgttcactttttttggttctctcttcaacttcccatccttatctttctctgcctcccaaaccctccccctcacgaccctgatatcctcagcccaagctctcacagtctccctctaccattctcctcctccaagtcctttacctcctcctgtcttaccttgccccactccaccaaataatgccagattcatgtggtgaaatgtttgtgttaccaaatgtattacatttttatttccactgattgtttttttaaaatcatatattgtgaacatatttgttataaaatatcagtattaccggtggtattttagtaatgcattaaaaaatggggtgatttaagatatacacctctatagtgatggaagtattcttgcctctatccagggcatccctaagtaatcaataaattaatatatttaaaataaaaggaatttgtttgatacatcagttccttgtgggtaagtggaaaatttgttatcaaacgaaatacgtaaatgagcagtaaaggagctctgttatatgtggcatggaaaagcactagtaagatattctcagactgctcatagacaagaaaatcaagaacaatcttttcaatagacatgaataggtgagttcaacgaacaacctaaacctaacctaatcttaaccatcctcaacctaatcccaccaaagagatgagagaatgtttttcctttaagtcactgaaatatggcttcctctttacagctggaaagactataactatgtttgcatattccaatggcttcgaggatcatcagagctcagggcatggaaagactgcagtgtaaactcactcattcattgcataggcaaagttttcttctggcctcttcagtgacttaacaagttctggctcaatacagtataaatcacacatgacacctcttctgagacagcagtatcaggtgtgagttggggtcctctagtagagttgtaaagggatcagaaagttctgagctgtgggcctgaacagctggttggtggtggcaacagcagctgtcatgaagaaatgcctttcccccaatgtgcttccctggctctcctgtcccctttcttgtcaatagccagtcaacatgtattgattgtgcagaggctaagggcttattcttctgtgcatgcttatccatctgccccttttcttttgacttacattgtctctccagggttttatttcgtttttataaacatctttctatctgcctgcttcttctcaccatatggcaattctgatatgtattttttgttggggggaatgtgagacagaaggagaggagaaagagtccctaatgacacaagatttagaatacttatcataagagtggatggtttaataaatactgctttcttcagcatgattttaatcagatgactactaaacttcttttcaaaaaaaaagactaatattcataaaaacaaatgttgtctacagccaatgtttctaactcttacctgtcaacattagacaattcaatctgacttcttgccttcctactccaataaaaccattttttccaagtcacaaatgacttccacataaatctaaagagcatttttcaattctcatcttactacactcctcagcagcattccagactcttaatcatgcctctttcttgaaatatcacgtggctcttatgacttcatactctcctagatttccccctctctctgcaaccacatctcaagctctttcaacagctccattgtttcatttaagctgtaaacattgggattgtccagaacttttccctcactcatcttatcatctcttctctacttactactatctgtaattgacctcatccaactttgtggcattaaatacaatctatttgcttacagttcccaaagttctatctctaactaagatttctctttttgagcaccagactttatatctgactgccttcttgactgctctacttggatttaatctgaatgaaactaaactctcaaagaaccccaacaaccttttcctcactcaccctgctcatcttgggaacccatctcctcacagttgttcacatcggaaatataggagtcactcttgatttattttccttccatcaatttctaaatgaaatgcttctgtagaaaattgcttttaccttccaactacatcactaattcactttttttgttttttaacatttttccctgtcaccgctatagtctaaatactgtcttctccagcatggaatatttcagcagtttcctaagtcgtcttttccattcatgccctcccaattattttttttttaatctagaaagcatctataatgagcagtaaaatgttaaaccctgaggatgtcactgtctggcttataattcttcagagccttcctactgaacttgtaataaacttcactctcctaaacttgcctccatgttcctcagtgatccagacctgctgatttctttgtttttatcttgtggcccacactcactcagccccagcagactcccctggctattctccccatatgctgtttcctccatctagaaagctgtgccctctactcttcatatccaggcttcttctcatcctccaagtgtcatcttacatgtcagtttcccagaagaaccttcctgacaatccaatctaaattagtttgtcactcacctttttgtagtctctatcatactatttttcttcatagagcctatcacagcttgtgttgtgtgtgtgtgtgttttaacaaccacacatgtctagtttaaacaatcatacaactagtgcctaacaatttacctggcagtgaaaatgctgcagtccccaccatcataatcattaaagatagactagtgttgtattaacacggatgatctgtatacagtatggacaataagcatgcataaggtcacagtagaagtttggataactggtatcaatcatagggtaatttgagaatatagtgaaagcaaagcagagagggaaagtatagaagaaaagggaggactatggtatgtgggcaaccctggggatcaaagtgaaaataaagaagatgcagtaattcacagaaaatcaaacccaaggaataaaaaactagattcaggcatgttttaatatactggaacatctagcccagtgtttcaggatggatgtaaaacatcacttctgaaataatgccgacaattctgttcagtctgtttaattagcttgttaaattcacgatattcagtttagatcatggtagatctaaattagggaatgctctggaggaaataccatgagttgaaaaaaatctcctctctcctgatagggatctgccttaagctactgaaggtgccagggccctggaggaatcctcaatgtctgtggtaaatgttttggtgggctaggtaatacccagttcatatagccaagcagtttgaagattgagcccagctcaggtggtggaccctacttagcctaaacctgtaatggtcatccctcaagatttcacatttaagccatggaaattggctaaaggagtaagcatgtgaccttatttgggccaatcaaatgaaagtaaaaaatttggagggattctgggaaatgtttccttattagtagttgagaaacacaggaaggtataatattcttccctcagactttgttgcatgcagatgtgaggtcagagactggttaccactttaggataaaaccagtgcccagaggaagggagagccaagggaatttcaggggaaagagactcatcaccagaaagagcaaccctaaatcaggccttctttagactcccagttaggagggcaatgaatatttttgtaggtttagccaatttaaatttgacattctcttatttgctatagaaagcatcttaactaataaaatgtccaagaaatacatgtatgaggagggaaaaaaaaacaccaggtaggctgtttataaaggcaaattttggaaggtggcaggatgatctgttatctccccacactccagcctttgggttacagtggggagaaagctgctgatagtttcctgacctcaatggttcaagctgtagcagaactagaatgggccaggtagtgactatatttctctcatgtttgctgaacaaggacactttattaccctaactttcagtggacatttttaattttcctaaatgaagaaaaaaatgcaaaaaaagaaaacacacatgtaagtttaaccacattcaataagcatagcacttgtcatcagataattgtaagacattgtaaaaataattctaatggcacttataataacaacaacaatagaaatatcaacaataatagcaaacatttagataggccttactatgtgctggacaccattctaaacactctcaatgtaattaactccttcagtctgcatatgaagtaggtattaccagtttgttaaaattactgataaggaaaccaagacagaggaagttaaatgacttgtccacggtcatacctccattaaatggaagaccctgttttcaaaatgaccattgtattctagaagctagggcttttaagcactaaccaagattgtcagttattgtgggtatataaattgaaagagatgatgaaaaattgcttttgtgttcagggagctcacagtttgttgtgctctctgtaagctcagccagtaataagaatacttgcttccagttttaaatacagtagagacaatgtctatattatgttatgtcatacattccacaatatttttgtgactgttggcgatttcttattgattgctttgtcaatataattttatatttatgccacccaaaaccacttctcattttcaagctacattaaaataataaaggacataaactgcaataagcatttctaggggattaaatattttcatcactaattttaccctataagagcatgatacatgcttcatttaaagttttaattaccaacaaaattttatgttttattattccagagacatatgaagcagttttatcacatgagccttaagtatcctctaagaatcagcaaaaaagagattgtttcctaggtctacataaccgatggctacattattatccataaaatcattcgagaaaacttcatgtgtggcagtatgagcatgtagactgtaaaatatcaaaaatgactctatttcatatgctaacaggaatagtccatcatgcagtttaacctgggacattagatagctttaagtcttttaagcctaagtgaagaagggtattgcattaaaactcccctcaagcttccctgcagacactttgagcataccatccctatcatcttggagagtagatgtaactaggtaacttccccagctgcagtaaacatttatatatgttggtcttctgctcccagaggcttcccaagctgctctgtcaaatctgttaatgtagaataatcaagccaagaagaaagactgcaaggaactgagtgcaaatcaaaaatgaagcagagaagacaggagtaagaatgaaaatgattaaagatcaattgatcgtcatacatagaaatggaattgttcacatacaaggacttagaaacaaaatcctccttaaatgaggaaaaatatacaagtcattttgcataggtcctaggagaagggattttacatattgatactgcttctttacaataccatgcttccttccagtggttaatataacagaagtgcatatcttgaaagctcaaagaagttcttggaagtataggaacatttaacgttaagttgtgatttgtggcgagtacatttgaaaaatattaattgatatttatttatttgaaaagtcttggtttggcttaacagcctctctgcacaattaggatatccagtttctcttataagggaacaaactttggaatcttatctgattccccttgtctgacccctatactcaccatcactggaaacttttttttttttttttttttttgagacagagtcttgctctgtcacccaggcttcagtgacatgatctcagctcactgcaacctccacctccctggttcaatcaattcccctgcctcagcttcccgattagctgggattacaggcacgtgccaccacacccggctaattttgttgtatttttagtagagacagggtttcactatgttggccagactggtctcaaactcctgacctcagacaatccacctgccttggcctcccaaaatgctgggattacaggcgtgagccaccatgcccagcccactgggaatatttaattcctatttgttgcagtaagagcttgtgtgtcagacacagaagctatcattttttatcctatcactgttaactatgtgatagtgcataggtttaatttcaagaagcatcagttttattacttaaaaaatgcctacctctttattttcagagtgttccagagtccctgaaataaataggtgagagcacatggacatttggtaggccctcaaaacacattgttatcatttcttccttccctctttttctttttttccccaaattctggaaacaatcctggatttcatgttttagagtggcaaacagatgaagaaaatgacatattttatagtattttccattcaagcattgcaattattactttatatgtactctcatttaatcactgatgtggtctcgctgtgtccccacccaaatctcatcattgtggctcccataatgcctatgtgtcatgggagggacctggtgggaggtaattgaatcataggggcgggtttatcctgtgctgctcttgtgacagtgaagaagtctcacaagatctgatgcttttataaagggcagttcccctgcacatgctctcttgcctgctgcctttgctcctcctttgctttccaccatgattgtgaggcctccccagccaagtgaactatgagtctagtaaacttctttttctttataaattatccaatcttgagtatttctttatagcagtatgaaaatggactaatacaatcactaaaatagccagtaatgtagttattggtatccctatgttacataccagaaagtgaggttcaaaacgttctactaacttgtcctagaccatttatttatctaaaaatatttgctgagtgtttgccatgttctaatcattaagcaggggccatagacacaaagatgactttactaaggtttctgtcctctacaagatctcactgtggtaaaggacgggggaacagacagtattaatacactgtaatagaggccaaggccagaagaggcaaagccctctgactcattttactacaccagcctgactcttgtgttcaataatattctatcgatctaactcttagctattcatagtgtaagtgggatcttgctttttcccctgggactcaccccctcttcagaggcatatctctttttagggtagtatatcttcccagagcacaatgccacacctttaccttcgctacaacacatcacctggtttcatcttttcccctggattcatctacccaatgtaaatatgcatctaaaacttcctatgtatcaggctttatgcgatgctctaaagataaaatatatacatgagaataattttttaattgctgtgcttgacaagtttagaatattaaaagggaagactgtcattgaacagataagaagaggaaaatatcatagatactgaaatagaggtatgtaagagatgaagtcaaacagacaaataaaaaagctaatctgtattctctgctttgtgttacagtgggttaaggaaaaagatgaagggttttgttgtaatatgttgtgattgagttgattgtggtacatgccagggtcctgttcaggtggatatttagaccttgaactcaggggaaacatcttgcttagagatatactttttagaatatttataggtgtcacttaaagatatgaaaaggtggattgcccagaaaagttgaggaagaacaggacaaagatgagcaatgacagagaaccagcctttgtgggggacaccctcaaccacaatcagaagctcgtccacagcccccagttttgtaacaaaaccacataccagaaaagggttgaatgaagtctattcataatactgttaagaaaattcactgaattgaaaatttttatagtttttattaaagccaatgagaaagagaaacagatgaatgaaaaactatgaattcaagacctcaactcatatcttagtgctccataaatgctttagtttatgagtcaaatagtgatattttaatttcaaggtgggatcttcaaaagctttataaatattattagctgtatagctgtaactgttatcattttagcacctaactcatacaattaacctttttttctttcaaatcatcagcatattaaaatactacagtgattggttgaattctattctcaatctgttttgagtaaatgtgctaatcttaaaagaaaaaaatgatactttgtatttcttatctttcagtaattaaaacaaataatctaatcgttacatttttgctacataatttgtttttttttttttaatttgaaaacttacccctaagggggaaaaatattcttgcttcaacctttttactaagacctagccttcaagagagaattataggaaataggccattaggtgttttgaagattgcttaatgcagcagttcccagggtcttatgctgagatagtaagtacccaggggtagtattatggggtgggagaaagcatagttcatggtaaaaataggtttggaatagccttaagttaaaaagagtactgtaggcttctcagagcctttaatgggcttgtgttcatgtcaaattctttagaaaaaaactggcttaaaagtactgatcaaaagaccatagaagataaaagaaaaaaaaacatggcagaaaccaacttgagtgatgcagtcagataaaatgaaaagcagaaatgaaatgacaaccttagcctgggtgtgtagctagagagacagaaggtgaaggtcaatttcactgcattacaaataaagcctatgtctgactttcagggaaattgctgttggctttatcaaatgtctcttggagtccacttccccctctaagtagagggacctagtctctttcctgccactgcatctccagtgcctagaacagtgtctgtcacagagaaaatgctaaaacattatttatcaaatagagtgaataataaataaatgacagttaaagcataataactaaaattatataatttggagacttcaatggatggcccacttgtacaaatgaagacttccaggtgtttcctaatcctgtctctatcctgagggattatacctaaggggttttccacaggaaaagtttgcacagccttggcaacctgccactgcacgtgaaggcacagtcaagagtggttatttgtgagaaaacaataagatttgaagagagtttgactgtcctttgcacagtatatttttgctcattaaataatgttaattttaagcttaaccctaaagcttggatttttatattgatattgcctcacatttataaaatagttttcagttctcttccaaattgattagctctatcagtcatgaataaaatgacaaaatagcccattgcataaagagggaaaaaaagcaaatcatgtgaatgattttcccaaggtcccagaattattttacagaagacccaagattagaaccaaggtcttccaacttctctattcatcgtaacacacagaagagtgaacatgaattccatctggtttgagaaatcccctgacttgcagtggaatggaaactttcttttaaaaataacctctatttaaaaagaagtctacatgactaattctcttaaaataataaaacaataataagaccacataaaagtcatctaaaaagcctggtgaagagaagatcaaagatgcttatgtaacgacaagatagaagccaagcttcagaattcaaagcttttgtgagctctaatcattttgcttgcattcataaaatcttaaacattttccctctattttttgatgtataatattcaatcaattgtaatggaatgtaagtggagagggctggtaatggctcctaagcatgaaagtgaaaccatggcccatgtgcagcgctgccgcccagaggggagaggcagccttttccttcgtatccggatccttttagaaaagagatatggcctgcgactgactggtgccacttttattccttttcttataagttaattgaaatagaagggctttgttttttccccttttccactctaaagtcaaaggcactgactaggttcactgctgggctatagatgtgtgtgttctttttcaatagaattgtacatttccttataaatatatgtaatatataatatatatgtaatagatattaaagggatgggggaccattctgtgacatcctgggcaatagcattttcccagtttattgagatttttgaattgcaagtgggattaaatcttcatgactgactcacttcttatgctactgcacaaaagctgagggagttgacatttaaactcatgtgattaaacaattcataagtcttttaaaactgtacattttgacatgaaaagaatgcaaaaatattcacaagctacttagctagtgaattaggagcttttaacagaaaaagaaaataaaagaaggctttttattttttcaaagaagtggttgtatacaaccactttctcaagttttctggtatgtatttatgagattaaatgtataaaagaatgtggtgtcttcaagcagttaaataacaagctcctgttgagaaaacatcttgtagcaacaaaagagcttttaattccaaatttaataaatggagggaggggagcttttgatggtaagaaatggaaaagacagaagaaagaacatttgagggatggtggagggtaaacaaaacagcactcagcctagaaggtattcattttctgtccttaatgtaaggaaaaccataaaaacatctgcagttgaagattcagaaaattttcacagagaacattgggtttttataaacaacaaaaagagtcacatcaaaatttccttccttgaaacatttatgtaacaggaattaggaataggaatcaaaatggttttgttgtgaatagttaaggcagagagtatctgcattttgtattactgagaagatcctgtagagagtatatcccttttgtcacaaaggagagattggttcatcatgtgccatcatgggttccaggactaggacatttaaataaaggcacatgcagaacaaggttagtgaatgaagaggacaagagcagacatccagtcagttaccacgatgatagaggatggtgattgccaccaaaagtcataacgaatgttttgcatgtcacttataatttcatatatatgtgtggtattccccagccaatattcagcttatcttggttaatctctttttgtgtcttttttaaagctcctaattgaaaatgtttttgtcaagatttgttaaagaaaaaagtattctatgaaacattatgtttattaaagaaaaatacatccagccaacattgttattttcatcctagcctgagtgaaaaatcacataagcatatcacttagaggatgatttttaaacagagtctattattatttgaatgacttcactccaatccaaagcacactgggaactgtaaaatgttacagacgctatttcatcataaaggcagtgtgttatgggggaaatcattcttagctgtatgggagaagacatgactcccgacccagccactcattgaccaactatgtcgcaatgggaaaatcacttataatctgatacttttcttatctgtaaaaaaagagaagagaattattctatatgctgggactaaagagaataatgagtgaaataaggcatatgactattattatttttgttattatcagcataaataaaactcatagcactttgtagtctacaagttactttcaattgctttattctatttaattctcacagcaactctctgaaacaggttttatggtctccatttttcagatgaggaaatggagtcaaagaggtcagcacctgtgtgatatgatcaggaaaataaagtgccaggactaaaattctgattttcagatgccctacatcatgacccactaccccaaatcatttcattataaatattctagtttcatactaccttacagagtcaacaagggatgttaggcattccacatctacctgaataattccagcaattggggtaccctttcctcctgaggaaacccatctgtatgtcactattctcattttttaaaagttctcctttctcttgatccaaaatccaactctttgtaacttctgcttatatttttctatttctgtcttctaagaatgtacaaaataaatgaaattccttttcaactgaatgacttttgagttactccaaacttttatctctcttctggaaactaatcctttctaaaatacttagaggatacacttgctagtctcctcatcacaatgattttttttttaactctggaaatatattagttgtcaaaggcatctttttgttgtgtccaatatagcgcttataatattgtgtttgattttatgttaatttatctatctctcctattaaattatgtgcttcttcaaggtggagaggggatcataatatttattttttatttgtttccctgagacctaatataaaccttggaacataaaaaacctttaatattgcatgttaaattagtacactaaaatattaattgaatttaaccctaagcagcatccccaaaattgatacttaattatagaaattcaatttatagagtgaaacaggccacagttcaacttgatcatttctttagtcaaggctatgatgtaataacgggctcttaatttgcagaaaggaggtagacactgtcctccaaagctaatggtagaatctaaaaagacttcacaagagaagtgacaggccattttatctggaattggaagaaaaattatgcttttatgtaaagcaaaagcagtaagagtttaattctacaaaatacattgggactatattatgtaaagttttggaaattggaaaaaaatggctaggactttacctgctagacaatagtgacaagcaaaaattgctaagcagacaagttatgtgatattaatgatttcaaatatgtccctgaagctgacaaacccattctaaatgtttttcagctttcccaaatcgagatgacgagcacctgaataagattattgacactctgaaaggggagcagaggtgaaagtcatggacatgacaaagagggaggggaagtggtgcttttggggtgctacatgaaggttaaggacatgcaccaaataatggaaggactttactccgttaatttattcatttaacaaatatttattaaatctttactacagatatggttcctgttcttatgcagcttacagtgtagtgcaggaaagggcacgatttaaaaggaataaaagtaaggtgggatcagttgtaaattgggccagcttcacaggcactcggccagtacagtcacacaaggccgtatgctcagaagagccaagctcttggagtttaatgttctgcagtcattgtcttgaaatgtttaatacttttatctttaaatctgtgttttataattaccatccaatgagacaatggagcttgtgttggaggtttgaagcttcagctttcatgcagttctggctttcccttcctctcccacctctccaggaaggttcttagctgcctgctctctgcatcctggtgtcccaggccctgtctggccttccccttcctgccccaaccactgccaccctccaagtaagtggcaataggtctcagtagcagaaggagtcctgtcctctgccattgcctccagagggtgcctgggcatgagcacaaggacagttgagtggatgcacacctaatggcatcttgaaggcatgggggtgctggtgggagcagcgggaatccgtgcctcagagggcagtgccctggcaaattcggtaggtgacttggtgggtgcctcacatctaccctctagcaagcatgtcccagaagggggattgtaatttcctgggggtttcttatccactgtgtatggagacggtggcccatggaagggaagattgatttcccctgtgacagtcagggcttgaattcttgttttgcacaaggatctgcagacaatatagcaggccctgattataaaacagctgaagttagggacagtctataagtacctaacccggtagggagtgtggaggcctcatagtttccccagacatttaatctgagactatatctaagaactggtaagagttatccaggcagaaaggaggatgaagaaagttccagaaagaaataacatatgaaggcccagggttgaatcggagcccagaaagtgttccaggaactaagagaagttgagtgtgatgggaatggaaatggtgagcaacatggaggcaaatggcaagtcacggttagagcggaggtcagcagctctgccatacaacaaaagggcttgggaagatagctggaggagtagcaaaattaaagagtgttgtctcccagtgtttgctgtgtttaggatccatcttacctaccctgtgcctgtagagtccatttttgacatttaaataatggttgttacagtattttctgtaatatgtcatgtggctggaatgagcccatcatcctcccattgtcgaacttagatcctggatccttgtcacctatgaatgtgatgaaaagtgccctttttcctcagatttctgcaagctgcatattttgaagaaaagtgctcatcatgaaatcaaacaatcacaagtttatcttgtgcttcatcgccagcctctactgagagaaatactgtagttatttcacccaaactctccctgggagattgtgttatgcaaaagctaagtgaatggacctcaagagtgtaccaaaaaaatgtctccaagttgcaacaaagcatatttttcagaactgacataaagtcgatttttttccttagtaaggattgtttttatcacattgacatttagtttattagagctaactttataagaccagttcctaaagagctttttacctaaatctgttgccattttctatagataagatgagaaaatgctgaaaaagtatggtttttccctcaaagattattcaaaataaaatcacatcatcagttctttaccaccaggaagcggcataattacctcagactttcaaggaaacaggtatgcccagcaattggtttaatttaggcttagaattgttttcttcatccaaattgctagttcatcttctctatccttgatatactttttaatggaaaagaatctatttctattattgacttgtaagagtataattgaaaaataattagcaaggcttttacaaatgaatgcaggaaagagaaaagatatatatatatatatatatatatatatatatatatatatatatatatatatatatgtatgtatgtatatacttcaaaagtagtttccaataaatgccactagtctggtatccaataaatgccacaaaaaattagaaaagagaactaacttttgtggcacttttaacatgcaccagacaagttagatatgattattccaacttaatattcacagcatcccaatgttacccaaaagaaaatgagacagaaagggttcaataaacttgccccatctcacatgagatttactgatagagccaagccttaaattcaagtgtatcttatcgtaaattccttgtctcttctgtctcatgttaaaacattgaaaactaaactggagtagaattctgtgattgaagtataatttgcaataagaaagtcatgttatttatttagtcaataagaaagactttaaatcaatgtatttttgccttagtgtaataattattggatgcatagtgcttaactagctttatcagtatctataatatgatttgtttaaatcatgtctttaacttttgttttaagttcagggctacacgtgcaggtttgttacataggtaaattgcatgtcatgggagtttggtgtacagattattttgtcacccaggtaataagcatagtgtctgataggtagtttttgttgttgttgttgttttgttttgttttattttgttattgagatggaatctcactttgttgccaggctggaatgtagtggtgcgatctcggctcactgcaacctccgcctcccgggttcaagcgattctcctgcctcagcctcccgagcagctggtagtacaggtgtgtgctaccatgaccagctaatttttgtatttttagtagagatggggtttcaccatgttggcaaggatgatctcgatctcttgacctcgtgatctgcctgccttggcctcccaaagtgctgggattacaggcgtgagccaccgcgcccagatgatacgtagttttttttatctttaattttctcccaccttccaccctcagtaggccccagtagctgttgttccctcctttgggttcacatgtactcgtgtttagctcccacttataagtgaaaacatgtagtatttggttttctgctcctgtgttactttgcttaggataatgacctccagctccatgcatgttgctgcaaatgacatgatctcattttttatggctacatagcattctatagtggatatgtaccacattttctttatcaagtctaccaccgatggtcaattaggtagattttatgtcattgctatttgaatagtgctgcaatgaacatatgcatgcatgtgtctttagggtagaaagatttatattcttttgtgtatatatccaataatggcatgctgggtcaaatggtaattctgttttgaattccttaagaaatcaccaactgttttccacaatggctgaactaatttacattctcatcagtagtgcataaacattcccttttcttcactacctcaccagcatctgttatttgttaactttttaataatagccattctgactggtgtgagatggtatctcattgtggctttgatttgcatttctctaatgattattgatgctgaacattttttcatatgcttgttggctgcagatacgtcttttaaaaagaggctgttcgtgtccttagccaactttttcatggggttatttattgcttgttaatttgtttaagttccttatagattctggatattagatctttgtcagatgcacagtttgcaaaatatcttcttctgttctgtaggttatctgtttactctcttgatagtttcttttgctgtgcagaaactggttagttaaattaggtcctatgtgtcaacttttgtttttgttaccattgcttttggtgtcttcatcatgaagtctttgtcagggcctatgtccagaatggcacttcctaggttatcttccagagtttttatagttttaagttttacatttaagtctttaatctatgatgagttgacttttgtatatggtataaggaagggattccgttttaatctcctgcatattgctagccagttatgacagcgccatttattaacgagaaagtcctttgcccattgcttgcttttgtcacctttgaggaaaatcagatggttgtaggtgtgtggcattatttctgggtactctattctgttctattagtctatatgcctgtcgttgtaccagtaccatgtggttttggttactgtagctgtgtagtatgatttgaagatgggtaacttgatgcctccagctttgttctttttgcttaggattaccttggctacttgggctcttttttgcttccaagtgaattttaaaatagttcttttctaattctgtgaagaatgtcattggtattttgataaagaatagcattgaatctgtaatttgctttgggcagtatggccattttaaccatattaattcttcctagccacgagcatggaaagtttttccatttgttgtggcatctctgatttctttgagcagtgttttgtaattctcattgtagaactctttcaccttcctggttagctgtatttttagatattttattcttttggtggctattgtgaataagattgcattcttgatttggttgtcagcttggatgttgttggtgtataggaatgctggcaattgttgtacattgatttgtatcctgaaactttgctgaagttgtttatcagatcacggaacttttgggcagagactatggggttttctaggtatagaatcatataacctgcaaacagagatagtttgacttcctctcttcctatttaaatgacttttatctcttcctcttacctggtttctctgcctaggacttccaattctatgttggataggagtggtgtgagttttgtcttgtgctagttttcaaggggaaagcttccagccttttccattcagtatgatgttggccactggtttatcatagatgacacttactgttttgaggtatattccttcaatgcctagtttgttgagggttttttacgtaaagggatgttggattttattgaaagccttttctgcatctatggagatgatcatgtggtttttgctttttgttctctttatgtgatgaatcacatctattgttttgtgtatgatgaaccaaccttgcatcccagtataaagcctactttattgtgatggattagctttttgatgtgttgctggatttggtttgctagtttttgttgaggatttttgcgtctatgttcatcaaagatactggcctgaagctttctttttttattgtgtctgtgccaggttttggaaacaggatgatgctggcctcatagaatgagttaggaaggagtgcctcctcctgaatttttggaatagtttcagtaagaatgataccacctcttctttatacattgggagaattcagctgtgaatttgtctggttctggactttttctagttggtatgctttttattactgattcaatttcagaactgattattgatctctttagggattcaatttcttcctggttcaatggaggtcatatatttccaagaatttaatcatttgttctagattttctagcttgtgtgcatagaggtgtccatagtagcctctgacttttttttgtaactctgtggggttggttacaatatctcttttatcatttttgattgtgtttatttggatcttttcttatttttttcatatcagtttaactaatgatctatcagtcttatttattccatgcaacaaccaactcctgaattcattgatcttttgtatgttttttcacatcttgttttttgagctttttgttttgttttgttttgtttttagttgtcctttgattttggttatatcttatcttctactcgctttggggttggtttgctcttctttctctagttccactaggtatgatgttaggttgtagatttgagatttttctaacttttaatgtgggcagttagcactataaacttctgtcttaacactttcttaactgtgtcctagagattttgttatgttgtatctttgttctcgttagtttcaaagaatttcttcatttctgccttaatttcattgctaacccaaaagtcattcaagagcaagttgtttaattcgcatgtgatttcatagttttgagcaattttcttactgttgatttctatttttattgtgttgtgatctgagagtgtggtgagtataattttttttgaatttgctaaggattgttttatggccaattgtggggtcaattttagagtatgtggcctgtgcagatgaaaagaatgtatattctgtggttttaggtggagagttttgtagatgtttttaagtccatttggtcaagtgttgtgttcaggtcataaatatccttgtaagttttctgtcttgataatatgtctaatactgtaagtagagtgtttaagtcttctactatattatatggttatctaagtctctttgtaggtctctaagaactttctttaggaatctgggtgctcctatactggatgcatatatatttaggatagttaggtcttcttgcaaatcgaaccctttaccattatgtaataccctttaatttttaaaatatctttgttggcttaaagtctgtttggcttaaaatctattttgtctgaaattagtatactaatccttgctttcttctgttttccatttgcctggtagatttttcttcatccctttactttgagcctatgggtgtcattgcatgtgagatggggtctcttgaaggtagcataccattgggtcttgcttctttatctaactcaccactctgccttttgattggagcatttagcccatttatattcaaggttaatattgatatgtgtaaatttcattccttcatcatgttgttagttggttactatgcagacttaattgcatggttgctttacagtgttaatagtctatgtacttaagtgtgttttcaaagtggctggtaatggtctttcctttccatatttagcactctgttcaggacctctcataaggcagttctggtggtaatgaattcccttagcatttgcttgtctgaaaaggaccttatttctcctttgtttatgaagcttagtttagctggatatgaaattctgggtaggagtttctcttctttaggaatgctgaatcaaggccctcagtgtcttctggtttgtagggcttttgctgaaaggtccgtggttagactgatggggttcccttggaaggtgtccttccccttctccctagctgactttgggaatctgtttactatgtgtcttggagatggtcatcttctgtagtaccttgaaggggttctttgcatttcctgaatttgaatgttgccctctctagtgaggttggggaaattctcatggaccatatcctgaaatatgcttccaagttacttgctttctctccttctctttcataagtgccaataagtcatagatttggccactttacataatcccgtattgcttagaaatattgcttattctttaatcttcttactttatttttgtccagctacgttattttggaaaactggtcttcaagctctgacattctttccccaccttggtcaaccatatccatgcagaactatggtaaagattacataccaaaaatcagaacaatttccatttaccgaatgctgaccatcatattatgctcgacattcatgaatatcctctgttgtggaaagcaatagtgcagtttgaaaaaaaaaatcaatgctgctacctgagggaaaggcaagtgagatggactttgaaagggaaaagagaaagtgaacccaaaggtccaaggtcaagtataccctccaacagatcagagaaaagatgaaaatacagaatgagtaaggttgtgtgaaatttaatgaagaaagaaagcaaaattgcagtagcaatagtatcacaagaataacccataagtgtgagtgtacctgcattcaccctgagatgcacaccaaacccaaacttcccttctcccaactaaataatcacaagttctttatctgcctccaattagatgctgaaggatagagaaaaaagcaaagaaaagtctaaagttcaaaacataatgcacaaaacattttatgactgcttactacttgctgtatcctggtgataaagagaagcagtagaaagaaaatcacactaggaaaagagatctgagagttgaaaggcagcttcccagaatcaagccaagtatatgttttcatgttatttgtgttgcatgcttccactttaagtcataggtacttgcatgtcaaaggtactctgtaagcactaagtgaatcaaacagaatgaaaggggagagggaagatgagattcatttagaagaagaaataagaaggcaatttacttttgcataggtgggaacatagttcagggctctttacactggctaaaaaggaagaaaaataataaagagagaagggttgccaatcacacaaatgtaaatgttcaaagatatatgagatttgaggtggaagatgtatgatcgtatgtgtgatttcctcagtgacaggaaatatcagatttatgaatatactatgctccattttcatctgtaagaggaatttgaaaaggaaatattattttgggtcatgacttgtcttctgcatataataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagattctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgtttttaaaaatgaaaataaaaatctcagtgcaaagaatacatttacttctctagtagactattaattgcagaatcgcaatacatatgatctccttcttctttgttaaccaagtctcaatcacatttggttaacaaataaaatactacactccccgtcatcccttgtagcgaaatgagcttataagtctaagtcctgcccagtgagatgtaagcttactattttgtgacagtctttctgggaaggctgcttaaagggagccaataagtcaaggagaaaggataatcgtttatccttccccacctcttcctgctacaacagaagggatggctggagctatagcagccaatttagactatagataaactcaaagaaggaagctccatgctaaaaatggaatataggaagaaatagactgtatcaccgataacgtcctcgtgccaccagaatgatttatcttcaaacttctcttttaactgaaaaaaaaagtaaacttctgttttgattaagccactctcattttcattattatttccttccctggttatacacatttaaagcttattccaactgatttagtacttggaagtaagtttcttcaagtatcagaaactaaaatgtggcactaaatgtgtaatggaagcagagctgcataggtgcatagcaatgactcagataatgaaagccaaaaatctcatgatctttataataaatctacaaaatatttagtcaagtcatcacctgctacacattggaagccaaccacatgctgccaaaggctacatatagtattaggagaaatggtaaaatattggtatgggttgtcagaaaaatcctagcatgacaaattcgaggtggaactaactacctggccagtctcagagttgaaacggaaagacatgcacctttgctaaggaaggtactctttgcctgtaacccacaatctcagttgactgagagtctggtaatttgaaaactttcatggttgaaaaagccaactgcctataccccaaattgaaacagttaaaagaagcgtctgaaaattctaggcttagcgataaatatgacttttgccacaccatacaaaagttgtgagcctgctggcaaagataatgcattacttcatatgttctcaatgcagcagacagcaagctgaaaattatttagatgcacagagcacagaggtctgtaaataaaagaccagggtcttcaagcttaataattccatttacccaaggtcattgactgtttattcacacttggagatgaccaaaaaacaactacgctgaaagtctgtcatactttttagggtatcttattgtccaaaactaatccagtgggtcatgaacccgtactaaaaggaagtggcttgctacatatgtgcagtccttagtgaagatattctcctgaatgtccatttcagatgtggccacagaggacaacagaaaaggaagaccctcctgaagagcaaatccaggggccacgaaagaaaatgaacaagagaatttttattgaagagcagaacctgggactgccagatggaccaactaaagaactcacttcacaactagggcagtgagtcctcaccatttcttctcagcaagagttggctgctgtaaaatcagagagattattcatgccttatggttaataaaagtatctataggtaactgaaccttgaggagccaaattgaggcctgatgaaggagactgtacatcatccagagagaatgaacttggagcaggatgcaaagactgcaggggagaaatcagggtttttctgctggaggaagaagcagagggtacatagacataaggtatccaaagaagcccactatagaagctgggacagattgcatacttattctcaattcttcactcctccctatgcagtagagcagagaaaatcgagtatacctgtgacttgctttgaccagtggaaagttagaggggacaagagcacaggctttaaacatgcccatatgggacttctgtgcctaccatgagaacatgccccataattgttaatgcagggagaatgaggagatgtggtgcagactcttagccaatcccaagagctgggttcaagggtagccaacactcatcctagagaagtgtcccctctgacctgcagacacatggccaagaaaaatcaatgcatgttgttgtaaaccattgcatttcaaggctgtttgtgatgcagcatcctggctaataaaccagccaggtctattctaacaattgtagctcagagtaaagaatgtgggcatctcatcagcagacatgatcactaaaaagacagagaaaagatacaatgagaaaactataagcaaactcttggaaatccaacgaacaaaatagaagaaagaagaaagattaagaaatttctagaaacatcctacagtggtcgggaagactgagatattaagcctaggagataaaaatggacaggcagattcatatcatgcttaaaaagaaactgcaaatgattgagaagttttttttaaagtggaactatttcaaaagtaagaaattagtaaagggacaaagttgttaatgcaccataaacaagtgatcaaaagcagaaaaaaaaatgaactgctgtggaaatggacacagtgtgatcctatttttagtggactacttgagttttttaaaaaattaggaggaaggtaaaaggttcagaaaatagaaacagaagtgtaaataatactatgaaatgggcctagctgaaacagctcacttttcaaaagaatacattaaatgaagaatacagaatgagatccttaaaaaaagaagtcaggaaagtattacatagagtaactgcaaaggccttctctccttataacacggaaattgatgtatttgagaataagggtattaaaaaagatctttaagagtctacaggaaatagaagagctaggacaaagcatggatgtcatgtagaatattttatgataaactgctgacctgagccaataattcttgggctggggaaaaaaactgtttctctatagataggtgggtgggggtgagggtggggagggaaaattgtaatgcttactttctaaatagatttcaaaggaatgcgggagaacacaaagagaactagcttgcattgttttttttaatattagcattttgttgataaaacagaaagcaggaagaaaaataatgaatcatgcatatagtaataaaaaagtgtggtaggtgattaacgtgttaagagtcaagggaagaactcatcagaagagtaaaagaagagaactgaaaagcaaagggggacaatcaacaaaatgtgaacatacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtgcaatactgagcgctactccttgaaggtgaacaacatagaaatattgttcagtgcaactcaacaaatgtttatttaacgactgcaatgtactgagcaaattttaggctctggtaagacacatcagtaatgaagacaaacatatgcattaactatatcaagcaggacaaagggctctaaagagaatgaatgcagttctccaaacagagatctctgctgtcactattgaatatcttgtaaactctccagaaacgtgtatgtgcaagcatgtgtctgtttgtgcatatatatatatgtgtatattttaatgctacacatttgaagataccttattacactattcatgactttgtgattttctcttaacacagcaatttggagattaccccctttcagaacatagagagagctacttcatttctcccaatagcatattttattgcatggttgtgccataatttattgaattactggcctttaatgaacaattatgccatttccagtcctttcttattcatgtaatgcttattcatactgtgctttacatatgggctaatatacctgttaacacaaatcttgagaagtgaaatttctgtcacccggcaagtgaatttttaattttgatacatagtgccaaatagccttcaaagtgaaacattcacttatattcccaccaacagtgcacaaaattgcttttgtcctcaaacttcctgccaatgccatttattatcaaaccatttgatccttgcaagtacagtaactaagaagctatctcattgctgtttgaattacaaactacaaatctcattgtagtttaaaatacaaaccataatggtcttattatgagcaaatatgagtaggtttttacatatttaaaactcttttgagtttctcttactgtgaattatctgtctataatcttggcctatttttaaaaattaataagttagaagaaatgagccaattttcatatatcttggcaggtttttccagtttcttattttccattcaaatttatttatggttgttttaaaccattttgacattttgatctttttttaattttgagattattgtagatttatttgcagttttaagaaataatacagagagaattccatatacctttcaccattttccctcactggtaacgttttgcataactacaggacaatgtcacaagtaggaagttgacactgacacaatgcatctaccttattcagatgtcagatttacattcacttgtgtgtgtgtgttagttctacacaatgttgtcacagtgcaatttcctgtgtgcactactgtggtcgagatacagacttgtgtttcatcgcaaggattcccttgctacccttttctattcacagtccctccttaagccctgacaagcacacatctgttctccatctctataacttggtcacttcaaaaatgaatggaatcatggagtctgaatggaatcatggagtatgcaatattctgagattggctttttccactcagtgtaattgtcctgcatttgtaaaaaaattggcatttcgaattttggtactatgctatttagcttaaggttcataccaaactttaattgtagatttaaactttttcattgtctttcgtttggtagtttcatgcagttttccctaaagtggaccttgtataattttaataaaattactcttgcttgcttttagttttaatttgtttacctatattttgcttcctgcctttattgattttagatgaatatcataatagcacctgtgtcattttgtggtccaaattggtggtcttttaatgagcaattttatctcattgatatttactgatatggcaattagctgtggcattttatttcaagttctactttctgtatttaatgccatttatttttgctatattgtctatatttcttgtatttgcatgttttacttttataatttggaaagcatattctcttcttcagattttctggtagtaacataatatacacataatatacacatataaatatatatgtatacatttaaagaaaggacatgagaaatgcacatacaattctgcaaaagaacaaatagaaaaaaggtaagaacacatcaaaatatttagtcgtaaaagacatgaaaattataagaaaacccttctctgagaattcaaagaaattttttaaaaagtcttctgatacatatatatgtatatatgtatgtgtatatatgtacacatatgtgtatatatgtgtatacatacatgcatatatgtatgtgtatatacatgtgtgagtatatatacatgtatgtagtatatatacatgcatatatatgtatgtgtatatatacacatatctatgtatatatgtatatgtatatgcatgtatatatgtacatatatatacacatatatatgtatcagaagactttaaaaaattttctttgaattctcagagaagggttttcttattttcatgtcttttatgactaaatatttttgatgcgttcttaccttttttctatttgttcttttgcagaattgtatctgcatttctcatgtgctttctttctgtttgtctttgttatttttgttgtttttccccaggccaactatgcattagaggataatgttagaaagcacatcagtggagtgagttagatattcaggtagcttgcattcaaatttgtgtcttgaaatgtttcccaacaaaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccaccttctctgacattcttttctgcccagcaaggttagtgatgccccagactctgacacagcagctaagcgcttgctgttccaaagtggccctgatgacatttcagaaagtgtaacttacctttggataattctgcgtgctttctgtgaacatggaggcacacacctcctgctgctttcctcattttaactagatttaaatttcataacacttttacagccctccaggttttcatttctgcttctttgttctctgttttggttttaagttggtttcaaagaacggggcagaaatgtctttactctgccatctttaattggttcctgtactctttaatacattttaaaattaaagccagagaaagaataattaaacttccatgctgcaacccatagaagttccaatttcttgtgtatacagactctctctctctgcatttttaagaagttccatacacttttaggaagacttactgtcttctccaccaacctgagacacgtacccctacaagggtacatgaaattccactcaacattctgtgagttcacaccaaagattcataaggctacacattgttccttctatcattttctaaaaggattttcttctcatattttcttgtatggttataaataacatgttcctgttcacagtttgtatttagaacatttgctaggcattttgttttcaatcataatccttagagccttgaaacaaacaaatcacatatactgtatagaatgatatctgcttggtatttctgccttaggaaataatgttcatttttgaggcttcattttaatgtacagcagaatttagtgatatcacaatcccctacacagttctagtaaaactaaatgaaacagtgtgaagctcctagctttatctgaactcccatgtctgaaatctgtcatttgttggtgtttagtttgcctggaatgtttgtttacctactgcctgttgactagcttccaaatcctcttgatgagttgatttcataacagctgaaaataacattgcattcctcacctgtaacaggtggtccccaagtggctgtccatcttcccttgtgttctctgctgtgaactgtaaatcatgtcaagaaacgacaacccattagatgacatgatctaccatcactgcgaggagccacccgtcacaacatgcacacactttatccatcctatgcgcaaataataaatttggtcaaaagattgccatttcatgttctggaaaacatgaacttatgtgagcttatacataaaatattttaatctataatctcatgtatatgtcattatgtcatatttcccagaattcagctgccaaaaataacattaaagaagtagttcatgtcaggtaagatgagaatgccccataaatactgattctgaacctctagcagccatacatatgttaattcattattccacaaatattttgtgcacatattctgtgccaaacactgtgctaggtccgaagaataccaaaattaatcattacaaactcagagtccaaagaaaaaggcagactcacaaataaacagctgtaaaaatgtgtgttgctctatttggaggtattacgtagacattagggagagagcatctgtattagtccattttcacactgctgataaagacatatccgagactgggcaatttacaaaagaaagaggtttattggactcacagtgccacgtggctgaggaggcctcaccatcatggcagaaggtaaaaggcaaggagaagcaagtcacatcttaacatgaatagcggcaggcaaaagagcttgtgcggggaacctccaccttataaagccatcagatcttgggagacttattcactatcacgataatagcacaggaaagtcctgcccccatgattcaattacctaccaccaggtccctcccacaacttgtgggaattcaagataagatttgggtggggacacagccaaaccacatcattctgccccagcccctcccaaatcttatgtcctcacatttaaaaaccagtcatgccttcccaatggtccccctaagtcttaactcatttcagcattaactcaaaagtccacagtccaaagtctcgttcgagacaaggcaagttccttccacctatgagcctgtgaaatcaaaagcaggttagttacttcctagatacagcagtggtacaagcattgggtaaatacagccattccaatagggagaaattggccaaaacaaaagggctacggaccccatgcaaatctgaaacccagcaggacagtcaaatcttaaagctccaaaatgatctcctttgatcccatgtcttgcatccaggtcaggctgatgcaagatgtgggttcccatggtcttgggcagctctgcccctgaggctgtgcaggatgcagcctcccctccctgctggctgctttcatgggctgccattgagtgtttgtggcttttcctggtccacagtgcaagctgtcagtggatctcccactctggggtctggaggatggtggccctcttctcatagctccacgaggtggtgccccagtagggactctgtgtgggggctccaaccccacatttactttctgcattgccctagtagaggttttccatgagaggcctgcccctgcagcaaacttttgcctggacatccaggcatttccatatagcctctgaaatctaggcagaggttcccaaaccccaattcttaacgtctgtgcaccaccaggctcaacatcaggtaaaagctgccaaggcttgaggcttgcaccctctgcagccatggcctgagctctacattgacacctttcagccatggctggagcagctgggatgcaagacaccaagtccctaggctgcacacagcatggagaccccagattcgacccactaaaccatttttccttctagacctcctggcctgtgatgggaggggctgctgtgaagacctctgacatgccctggagacagtttccccattgtcttagagattaacatttggctacttgttacacaaatttctgcagctggcttggatttctcctcagaaaatgggattttcttttctatcacattgtcaggctgcaaattttccaaacttttattctctacttcccttataaaactgaatgcctttaacaacacccaagtcacctcttgaatgctttgctgcttaaaaattttttctaccagatatcctaaatcatctctagcaagttcaaagttccacaaatctctagggcagcaacaaaatgctgccagtctctttgctaaaacataacaagaatcacctttgctccagttcccaacaagttcatttccatctgagaccaactcagcctggactttattgtccatatcattatcagcattttggtcaaagccattcaagaagtctctaggaagtttcaaactttcccacattttcctgtcttctgagtcctccaaacggttccatccaatctcttcctgttacccagttccaaagtcacttccacatttttgggtatcttttcagcagtgccacacttcccataccaattcactgtattagcccattttcacactgctgataaagacacacctgagactcagcaatttgcaaaagaaagaggtattggacttacagttgaacatggctggggaggcctcataatcatggcagaaggtgaaaggcaagaaggagcaagtcacaatcttacatggagggggtcaggcaaaaaaagcttgtgcagggaaactccaccttataaagccatcagatcttgtgagacttattcactatcctaaaaacagcatgagaaagccctgcccccatgattcagttacctaccaccaggtcactcccacaacatctgggaattcaagatgagatttgtgtgagaacacagccaaaccctatcagcttcattctggggtcaggtggtagggacaacacaaacaccaagataagttcctttggagatatggcatgagctgaggcttataggatgaataagaagtatgcttggtaaaagagttcaggcaggaaggcattggggagtggcatttcttggtaaaggagttcaggcaggaacacattggggagtggcatttattgtataggggaaggagcaaaggtatagagttgagaaggaggttagaacacgcaaggaactacgagcaatactacaggagtttacttagtgatgctggggccagtgagatatgtggagcagtaagcaaaaggcaaggttgaggagcactccaggaacagtacgtaggaagccaggctggatcctgtggtcaggagcttctgaagagcttgctgttgtggatatttgcttgcacttaaataacttttgtattagtctgttttcacactactgataaagacacacccaacactgggtaatttataaagaaaaagaggttgaatggactcacaggtccacatggctgtggggggcctcacaatcatggtggaaggtgaaagccatgtcttacatggtggcaggcaagagaggatgagcgccaagcaaaaggagaaaccccctataaaaccatcagatttcatgagactttttcactaccatatgaacagtatgggggacaccgcccccatgattcaattatctcccaccaggtccctcccacaatacatgggaattatgggagctaaaattcaagatgatatttgggtggggacacagacaaattatataagctttattgaggtttaatttacatcttaagattcacttaggtgaacaattcaatgattactattaaattgacagagttgtacaatccttaacacaatacaggttttagaatatttccatcattccagaatatccctcatagccatttatagtcactactgactcctacctccaagaaccaggcaaatgctcatctgctttctatgtctatagatttgtcatttctggacatttcacataaatggaatcatagaatatgtagtcatttgcatctggtttgtttcatcaggcatcaggtttttttagatttacccacgctgcagtatgtatccatagcatatttgtttgtattgtaaaatagtattccatggtatggatataacatcattggcttatcttttcaccaattgatgggcgttcagattgtttctattttttggttaatatgactaatgctgccacaagcattcacatgcaagtctttacacagacatgttttcatttctcttgggtagatatttagggatagaattcttgggtcatatggtaaatttatgcttatctgcttaagaaattgtcaagctattgtgaaaagcagctgcatgattttacaatcccatcaacaatgtctagggttctagtttctcctaaggagttttaacgagacggataatatggctagatttgtgctttaggtaaatcaatctgatagctactaaaaatgagactgaaaataatgagcctgtttaggaagatgttacaataatctaggtgagatctctactacgattcccaactagaccattggaggagaagattatctcagaagaagaacaatgctgctgaataagaacaggtgatttgcttccatcagttgctcagccttgggaacgtgacttaccgtggtgtgaggacaaagcaggtacctgcccgccagccagattagctgaggaaaatacacttcaggtatgtaagcttatgccttcacatctgaaatgtcctgtactaacatatacaccctcaaactttccaacacttatactatcactgtgtcattttttcctggttcaccaactgcatactggacacagtgctgcacatgctattgggtatttttcctactttagagattatgttcatttggttctaaggataattgcaagaatattgttgtgctataagtaaataaatgctatgtatttataaattatgtgttaaaattatactatttctattgttagcacacacagtattaagtcatgtggcccaaatctcatatttcatagcatattatggttttattaggatacagtaaattaatatttcagtgagaaagtatttggaagtacccataagccttatcaacagctcatcccaatgtttcccttcaaacagccacgtggaatttgtgtaaatgagtctaaatgaatgataaggacaatatgatgtttgagttaaaatatcttttgaaactgaaaatgagcagctagccaaaaaaaatctgtcactttaaaaagatcaggaaaaagtcttaattctgccattgtgcaatgtatagcatgtaactaagaacaatatctaaggacaacaaatataaatattgaaggaagttgagtaatatttaattagattatactatatttggtctaggaataataaacctgtaaaattatctacactatgaaactaagctctgtattataacatataaatgagttctctgatcttttaaaatatgtatttctaacaaccttgtaaatgattaatatttcaaaatactgctactactgctgctactactagtaataacaacaattttgaatagccttgaatgtcttaaaagttgtaaaatataattttattcatgatgattaagttccatgtgaataagagaaataaaatgactacaaatatttaaccaaaaataaaagaacagagggtttgtcaaaagagaccaatttacttattaaatagaatgaccatacattacagtttcctggaatgaaacacttttataactattgtcctgatggccaatccagtttagcattttgtccttgattgctttacctttcaacaaagtattattatcaatgttatgattattgttatcattaatgaaaataagccagatggacttttacaacctctacttcatactcccaatctttgttataatcatgtctaagtagcacgagacaaattcagggaatgcagttctcaccttaaatgggagttaatcttaaagaagaccagcagtaataacctatctcttcccatttcagactcaacgtaaccaatacctgcctttcaaggaaaactcatatggggctcactgacgaaacaaagcgagtttgcaaaaaaagatttgacatagtcaattctttgtactcttcagtgatggcagctgccttagtggaaaatgtgggaaattacagattggggtaggtgaattgaagataaaattatttatttttgttgttataaatacaaattttgatataatatagcatcatgtgtaaaacaattttcctaacttaagaaatatgtggaacagaaatatttgaaatgtggtggtgtacaaggaagtgagcttgaagaaaagagggtcccaaaaattcacgttttacaccaagagaaataaaaccgtagtagtcacaatttatgaatatttttacacttgtatatatatacttgtgtatttgtgtgtatacgtatttgcaactgaattataaactttaatgattaagctgatttgaaataattttaggaaatactttagtatggcaatacatacttggtctttttgttgcccataatcaattagatttgagaaataattaacctttgaataacctctttgcaaatttacttagttatcctagcaaagtattaaatattttgtaaatgagtcctgacatttctgattgtatgtttttcaaaattgttggaaatctttaaacaaaatcctggagcatccaaatttcaactactaaagattataattttttgagcacccatatttcaaatatgaaagcttttggcaaattgcatttattgaaaataaagctttcatacaggaagatattgatagctcttaaaaagcaagggatacattgaattgattagatgataagtgggcaaatggtatggaggatgtaattttaaaattctctaagagcatattgaaatgtattaacttttaggaagaattttgatgagcccctatttttcagtaaatttctttttaaacttgtattacattttattttgtctctattttttgttattattattatactttaaagttctggggtacatgtgcagaatgttcaggtttgttacataggtatacatgtgccatagtggtttgctgcacccatcaacccatcatttacattaggtatttctcctaatgctatccctcccctagcctcccacccaccaacaggcccaggtgtgtgatatttccctccctgtgtccatgtgttctcattgctcaactcccacttatgagtgagaacatgcggtgtttggttttctgttcttgtgataatttgctgagaatgacagtgtccagcgtcatccatgttcctgcaaaatacatgaactcatccttttctatggctgcatagtattccatggtgtatattgccacattttctttatccagtctatcattgatgggcatttgggttacctccaagtctttgctattgtgaacagtgctgcaataaacatacatgtgcatgtgtctttatagcagcatgatttataatcctttgggtaaatacccagtaatgggattgctgggtcaaatggtatttccagttctagatccttgaggaatcaccacactgttttccacaatggttgaactaatttatattatgtaccattatagaatgaaaatgaagtcaatgatttgatggtaaagagctgcatataatatgactaatactaaaataataaataattttataagaactgaggtataggcccaccagcataatcaatctaattataactatttcaaaaattctattattctaattattcaactatctgcatttactatcaaaaatgcttcagcttgagaataaatgatatgatcatcccagttttgatcaagtaactattggtggacacttttgtgcaactagatcctaaaataataaaagcctcttttcttcatcatgatagaaataaaaattcctctttccaagtgtctctttatgctcatcctacaggaaattcaattaaagatattatacaatactggatgttaaggctctcaatcaaatgttgccatttatttcattaaattgtcttcgtaacaggctaattaaattattgcccagtttagaatgtaatttctatagcttatacaaccaaacttaatatccttaataattcaaaaacagctatatttttatacttgaaaattgtttctgcatgttgaagattacagatttgcaaatgttctggcaagtgtgagcctctttgaaagtagatcatatccttaaatgaatagcaaataaatcacagccacaaaattgcgtatattgcattttgcaactgatagcctcttagctgctcagactgttatttaaataaaatgaataattagagcagaaaactgaagagaaggtgttatttttatctctgtactcaatagaatgttttcaagacaaaaattagtaaggagcatgcttgctcaatttctttaactttaaatcaatgtttactctctgaacacttatattgtaaatgttaagtagaggcttagaaactgataatactaataataaaaaatgaaaaattgagtaggctatccagttatttgccaatgtttaaaagctatttggcatattattggcacaatttagctgacataactcaggtgcttaatttcattaatttcaagatagtcaaaacatttggcatgaagattaaaggaaactcaaaatataaacagaattaaaataacatcataaaaatagtagttgccgaaataatgaaaaaagtgttaatagcaataaattaaggcacacatcaatcaatatgaaaacatactataaatgatgtgaacaaaagatacaagttaaagaggcaaacagtcaataaatatgcgaaaaattaaactcacaaataaataaatgcaaattaaagtataagcataatgaaatttttgctctccaaattaacaaataatttattatctcatttctctctgtggacaagaatatgaaaaagatattctgataacctcctggtgaggcagcaatttagtataattttttgaaaagtaatttaaggccaggcgcagtggctcatgcctgtaatcccagcactttgggaggccgaggtgggtggatcatgaggtcaggagatcgagaccatcctggctaacatggtgaaaccccgtctttactaaaaattaaaaaaaaaatgagccgtgcgtggtggcaggtgcctgtagtcccagctacttgggaggctgaggcaggagaatggcatgaacctgggaggcggagcttgcagtgagccgagatcgcactactgcaccccagcctgggtgacagtgcaaccctccatctcaaaaaaaaaaaaaaaaaagaaagaaaagtaattttaaaatacatattaataaagatattatacagtatctttgtatgtctttgaccatatgtctatttattttaaaaatccatccctaattatcagaaatgtgaacaaagatttatgcatagtgattttaccgctttttagttataaaaataaatcctgagtatgacctaaatgtacagcaatagagtaatagtttaattaagatgtattcatagaatgtaaaaagtattcaatgatatgaaacttctttatttttaagtgaaaaatgatggcaaaaatatatacctccaatgtatctatgtctgtgtctatctaaatatgttcatctatcaatgtatctgtaaccctttatgtttacaaaattaaaacttagaagactatatctcaaaatgtcatttcttatttgcatcactgttttgacaatgaaaatgtatatttcctttacaatttgagagacattttacaaaaaaattagtccaaattttgtttaaaatgttaagagcagcataagttttgtaggactttaaagtaagaaagtaaattaaggtttttcataagatagcaattaactggtcattttaatctaaccagtaaatttgaattaatttgctgctaatgggtttgctttagtttaaaagtatatggagtgccttagactcttcaggctactataataatataccataaactgggtagtttatacacaacagaaatttatttctcacaggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagataccacctcctgattcgattatcttcatggttaagatttcaacacatgaacttggaggaacacaaacattcagatcatagcatggactatttgttattagtattattattatttcttaattacaagtttaattaaaggaaccaatagctagggaatacagccaagtttgtttacaagtatgaagaaccaccagtgctacaatcacaaaaaataatctatgaaaccactgttgaaaatatttttatgttatattgcaaaaatcactgaatttataccagtgtttatggcaatatttgcccaatttacaatcggaattatgttggtacttttttatatgtcaaagagaatacaaaagtcgctttgtccttataaaatataatcggtagattaaattttaagctcactgaagtacaaataagctatctagatagtataaaaactagttagaaaaaaatttcaaacaaactgttggtttgagtttttttcttcacagtatataaacatttaaataaaaaactttaaaataaacttcacacccagttttctcatgtttaagaaagtcagtacaaagtagtagttaataaagctggataagaagcagattacctggaactaagttctgctctggcacttataaattgtattatttagggcaagttatttaacttctctgttcttcagtatcctcatcaccaaactgggaataataattgtatctacattaagggattattttaaagatacaaagagctaataaaatgtaaagcacataaaagagtacccaggacacagtaagagcttaatcaatactaaccttaattattgtgccctcagtctacactcatacttttcacagcaaatcttgagtgaatagtatttactttttttcattcatttcagaagcatttgttgagtacctaacaatatttgtaattttgaaggcaaatgttggataagccctggtggggaaaaaagacaaatgtaacctattctgacctcaaataatgcatggcttcatgatagagagaaggatcctataaaaaaaaacaaacaaaccaaaaaagttttggaagtacagaaatgtactggctgcagaggagcaggcaagacatagaatctaggcagggggttgggattaggaagggctagtctctgggaaaatcattcatgctctggggttcaaacaatgcattgaattgtcttgaaaaataaagtgaaatagatatacgggggaaaaataatccacacaggcacagatgcaaaagagattgtgatgcatttgaggaaatggaagaaaactgatttggctaagttcaggatacaggtgggaaagagaattgtgaaaattgtggctgtataactaaggagaggtcagattatgaagagccttcaagtagagtaaacgtataatttattgttgtaccaaactatctttgcaagtgagggggagaatactaattattttacccagaacacaagcataaaacaaaaatctccatagtgacttggaatgtatagtacttctaggccatgattactttcatctatgcatctatgttctctccatctttttttttttctttttttgagacagaatcttactctgttgccgaggctggagtgcagtggtaagatcacagctgactgcaaccttgaccttctggactcaagcaattctcccacctcagccttgcaagtagctgggactacaggcacatgctgcgacacctagatatgcatttaattttttgtagatatggggactcaccatattgcacaggttgttcttgaacccctgtgctcaagtgatcctcctgtctcagcctcccaaagtggtggtgttacaggcatgagctacagtgcccattggcatcattttacctttaccttgggtacatgtatgtgttgcataagggagcagggagcacagggagaggagaatctcacaggcaagggggttctggtaccagataaaggagatagatacaaagataagccaaaccacaaatgcttattcagcattcttcctgaactatctttcctcccctgaaactcctttttctttgttttcttcttgtgtctttgattacttttttcaatttcctccatggggttctcttttttaatacgaatttttttctttgcttattttcttttctctaactgtatgtagagagatatgaaggcaaacataaccctccctacagtgtcaatttcaatcttattttaatggttcctgaatgtttctcttggtactgaaaccagcccaacttcctcacagaactgatgtttatagtttttagataaacataaaaattgactcaaccaatcttaaaatgtaaaacttaaatttgccttatctgagttcctttctcaggaaacccactctcaggactcccaaataatccataagtatctctgagtgacttttaggtgcccagtaactatagcctttttcacaaatcagggtctcatatctaatgctgggtccagtaagagactttaaacttcatcttaggccctccaatatgactataatatttgcatgtcactaaaatattgtggtgttaggaaggaagaaggacaagagaaaaattcaaagaaggaacttgaaaacatttttaaagttctatgtaaggaattccacaaaaacaccttttatatttttttcctgcaagaataagaaaatccaacgcaaaattgcttaagcaataagcaaaatgtattatttcacatattaggaagtctaaagtttgaaaggtttgacagttagataattcagtggcatattgacatcatcagtgacctaagtgttttctatctttatgacctgtcatcctcagtgaattgctttgccttttatggacccaagatgactgtaaaatgtagagaggcataaatgcagtctttccttctatgggtctccttaatggactttatccagatggttcccagcagatgtctcttttcagcctatttaccagaactgtgtgacaagaccaagccaacactatcaaggagaatgttcttgatctgattcttttaacccatctttatttacttcttggagctaaaaataatccagagtgcagggacacgagatacctgaacaaacctgagcttctattaataaagaaggtggaaaatagtggtttacaggaaaacagcagtatctgctacattctacattcattctaggttataaaacagttcctcacgacagagctagacaggtgtagaaccatacacgatcaagatgcagcaaatcaaagagctgtgtgtctaagcatctgaaatccatctttgacaatgactatatacatgatatgaaaaaaattttaaaaggttaagtgatagactgatttgagttgaatctaagccgctcttcatattagttgttctattccttcttatgctcctcactaaacctcagtttcttaatcaatagtcggataaaaatagaaaaataatgagaggaaagttctctgtggtaacacttatatgattctgtagtagtctgactgtttgtgcctttaccttatgacactataaacttaatagacttccaactcccagtcccacatataaggagcttagaagccaccactccatcgtaacaataggtaaaaagctgaacaaactgaaaagtcaacaattctttttagatccataaaagaggtgaagatccaggcaaactagtggctccaagattagagagacacacagacaaatacagaaaggggagtcatggcttatctaaacagagacttacaagtggaaaccactgcaggaactagtgccagggtagaaaaacctaaactgtaattgatgaattgctggagaatcagcgtggacaagtcagagtttacagctccagaaggacctaagcataagggagactccatacttttgtgtcttttatctctaagaacttgacccagtaaatattggataaaaatttctttgtgctttcagcaaagtgaggggaaaatgaatcattttgaagcatgctagaatactctcttcttaaaaaggcctccctgaagaaaaactaattaactagaccctaatttcataggagtattatcatagtctaactaacctggaggaaaggagatacccgacttcagccaggtctattattccacaaggcagaaggaaaataccaatgtccagcccactgtagccatcttgtcccacctaaaagcaaagaaaaagctgagatatacttatgaagtacagtctagaggcataggatccctgaaagacttggaactaatcatgagactatgaacatttctcctcccacaccttaccaccacattataaatacttatttacaaaaagctagttccttgaaaagatcagtaaaattgataagcctctaaccaggctaagaaaaaaagagagaggacacaagttactaagtaaaagaaataaaaaaggatatatcactatagatcccatggacattaagaagagaacgaaagggcgggcgtggcagctcacacctgtaatcccagcactttaggagcctgaagtggggggatcatgaggtcaaaagatcaagaccatcctggccaacgaggtgaaaccccatctctactaaaaatacaaaaattagctgggcgtggtggcatgtgcctgtagtcccagctacttgggaggctgaggcaggagaatcgcttgaacccaggaggtggaggttgcagtgagctgagatcacaccactgcactccagcctggtgacagagtgagactccaactcaaaaattaaaaaaaaagggagagaataaaataatactatgaacagctctatgtccaccaatttgataacctagaggaactaaactaattccttgaaagacacaatctgtgaaaactcatgcaagaagaagtaaataatctggatagggctatactttttcaataaattgaatcaataacacataaccagtcaaaacagaaggcatcaggcccaaatttattcactggcaaattctaccaaacatttaaggaacaaattgtattaattctctataatctctttcagaggatagcagagtaaatgcttcctaacccattctattaagccactattaccctaagactaaaatcaaacaaaaacattataagaaaagaaaaccacaaataaagatctctcatggacatagatgtaaaaatcctcaacaatatattagcaaatttaatccaacaatgtatgagaagaattatacaccattaccaaatggaatttattccaagtgtacaaggttggttcaacacttgaaaatcaattaatataatccaacacatcaacaggatataaaaaaaaagatcatattaatagatgcagaaaagtcatttgacaaaattcaacatacatttgtaataaaaaaaaactcagtaaactaagaaggaaatgttctcaacttgataaagaatagctacaaaaaatttacaactaatatcatacataatggtcagcaacatttccaaaaagatcaaaaaaacacaaagatgtctcctttcagcactccttttcagcattatattagaagtcctatctaatgtaataagacaagaaaaataaatataaaatgtgtacagattgggaagaaataaataaaactatctttctttgcagatgacaggaacatctatgtagggtatccaaaagaatcaattaaaaaaactcctgtaactaataagggattaaagcaagtttgcaggatacatggttaatagacaaaagtcacttgtcttcctgtatgccagcagtgaacaagtggaatttgaaatgtaaaacacaatacatctacactagcacccccaaaataaagcttgcaggtataaaggtaacaaaatatgtacaagatctatccaaatgtagagaaaataaatcaaagaactaaataaatggagagaattccatgttcatgggttgtacaacacaatgttgtcaagatgtcagttatccccagcttgatccatagattcaatgcaattccattaaaaatcctagcaagttatgttggggatatcaagaaatgaattctaaagtttatatgaagaggcaaaagatccagatagccaatatagtattgaaggagaagaacaaagttggaggactaacactacttgacttcaacatttactttaaagctacagtaatcaaaacagtgtgatactggtaaaagaatagacaaatagataaatgaaacaaaatagaaagctcaggaataagcccacaaaaatattgtcagctgatcctgagaaaggagaaaaaggcaatacaatacagaaagagtcttttcaacaaagagtgctgaaaaaactggacatccacatgcaaaaccatgaatctagatagagattttgcattcttcataaaaactagctcaaaatgaatgacagaactgaatgtaaaattcaaaactacaaaactccttgaagataacatagggtaaaaaatagatggctgtgggtttggctatgatcttttagatacaacaccaaagctatggtccataaaagaaataattgataagctggacttcattaaaattaaaagcctctgctctctaaacagaaagtgtcaggagaatttgaagacaagccacagaggaagagaaagtgtttgtagaacaaacatctgacaaaggattttattcaaattattcaaagaattcttaaatcacaataaggaaacagcctgatttaaaaattggcaaaagaccttaacaggtgcctcaccaaagaaaatatacagatggtaagtaagcctaccaaaacaggtttcacatcatatgtcacaaggaaaatgcaaataaaacaataattagatattactgtatacctattaaaatagccaaaatccagaacactgacaccacaaaacgctgggaaggatatggaacaacaggaacttttatccattgatgaaaggaatgtaaaatggcacagccactttggaagacatttcagcagtttcttataaaactatacatactcttaccatgcaatccaacaatcactttctgtggtatttatctaaaggagttgaaaacttatgtccacacaaaaacctgcacacaagtgtttgtagcagctttacttgtaattgccaaaacttggaagtaaccaagatgcttttcagtagatggatggattaataattcagccaatggaatattcagtgctaaaaagaaatgagctgccaaatcatggaaagacatgaagaaagcttaaatgcatattactaaatgagagaagccaaactgaaaaggctgcatatccaatgatatgacattctgaaaaaggcaaacctatggagacaataaaaaataaaatcagtggttgcctggggaggggggcaggaatggagcatagaagatagttaaactactccctataattctatagtggtggatacatgtcattatacatttgtccaaacctatacacaaggagtgaaccctaaattaaactatggactttgggtgataatgatgtgtcaatgtacgtttatcaattgtcacaaatttgatactctggtgagggttattgataatatgggaggctatacatacacaggggcaggggaaatacaggaaatctctgtacttacctctcaattttgctgtgaacctaaactactctaaaaaatacaaaaaaaaacctctttctaaaaaaaaactctttaagttgaggaatgtatcttcttcattgtgtccccggtagctagtacagtggcagaattgatggcttttaagtatagctaatgactgaaggagcatgttataaaatatttattaaagcctgttctataatatttggcaggtaatagacatttaataattattagatcatagctgatgatttgactcttgacagaactaattgctacttacatttaaataatgctaattagaatgacaggctattggaaagcatgcagaagaaacatatggaagttaataaacctagagtcaaggcctgcccttctcacagttattcaaccctaataaatagctttctcttgctgactctcagtttcctcacttataaaacgagcacattacctacctcataacgctgttgtgatgttgtgatgactaaacatttcttacagttactaagtggctctatgatcacttcaataaaactatgtgccaagtttctatgtaatgatagcctgagaatccccaaaagtattggttgctttccgaccagtcaataatagcttactaatttatctgggatctcatgtgacttgcttcgtctgttccaataaatttagcataaattcaatttgttcaaaacccactactactactactatctaacatttctagtatggctactttgtactaggttcttttctaagtattccatgcattcattcatggaaacacttttattattacattttgcagttgctaaaactgcattttacgtaagacaaaattattttcctgtgtttatacagtttgtgagaagcaaaagcaagttgtatacccaagtttgcctgattccagagtcaggttagttatccaccatattataacaacactcaggcaaagtttacatgtctagttaatgtcaataatggtataaacaggaattaggtaataggccatttttggctctcttagtgagatagtaattaaacattttagctgaaatttctctttactataacataccacttgataaagcatacattaattctagtctggttttgctgttgagaaattatctacatttactaccttattataacatattattcttttcattttaaaaatggccattaggtttatcttacttataatacaaagtgtactttatttattttttaacttttattttaaatttaggggtatatgtgcaggatgtgcaggtttgttacataggtaaacttgtgtcatgggtatttgttgtacagattatttcatcacccaggtattaagacttgtattcattagttattttttctgagtgtattttaatagaaaactaaacactaatgaaatcactgaagatatcataggaatataaaaccctcaagagatgatttagagttttccattttcagttcatggaaggcaaggtttccactcaacagagaaagtacaaaatggcagtcatcaggactaaaacattacaactgtagaagttacacaatgtaaagcttctgatattataggcacaaattacatcatgaaaccatttcactagagcacattagtaaactcagtttccaacggatttcccttggggccctcgccgtattgaaacaatcactatcttaagaagaaaaatgtgttcatttgttcccatgaaccagcacctagcatacctgtcttccacatcataggtatccaataaatgtttcctgaataagcaaatgaagaatgaatgaatgaatgaatgaggaaatagggaattcaaatttcttccagtcttgaaaggattgatagtctatgtggacagagcatagatgtaaatagatttttaagaaaacaaggtgcagacatgaatatttaaagaactttctaaggactacaacaattgatagaaactatctcagagatctgtggggcaggatgtaactccgaaggcttgctatccacttataacctcttccactggctaagggagacagtagggacacactgcatagaaacaggaagaaagcaataattaatgttttttaaagaaaaccattaatagttaattaagaattaagggcccatggtctctgaggttggagtcatttcaaagtactagaaaaaatgagcatagggaagaaatcatattcataagtaccttgctctaatatttccaaatgtacatcaagagaaactgttgcaacttgctgactttaaaattctagccttctctggcttcatgaaaaacttgctagcctcctgcaaagttacagttcaatctgcttcacattgggtaaaacaatacccaaggtacagaggtgctgaaaggcttagttattgttagttatgggagttgacaatcttgaataaaaagcactcttagtgcaaagtagaattgtaatcagtgtcattgtcatttgaaccacattgtttgcagtgtaaccaattgtgaaaccaacataaattcaaaaactaaattagaaaaacagatgcttcttttgtttggagattttagtcccatctagccatattgtatatcattttctttgacttacaccacatagaaagaaaaatcagagagcataatacaaaaatgcagaaacatatttagcaaatttgtggatttcataagtcatttataaactttggatttacaaacaatttcaaaggcttttgaaaatatttttttttttttttttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcctggctaattttttgtatttttagtagagacggggtttcaccgtttttttagccgggatggtctcgatctcctgacctcgtgatccgcccgcctcggcctcccaaagtgctgggattacaggcgtgagccaccgcgcccggcctgaaaatatttatacacacaagaatctctataatactacatataattataccatggcttttccaaagcatattccagagatagactttcggcagaatatcaagtttcctatttggggtttgtcttggagacagtgaacaatttatttttcagtctctgtctccactgatgcttgtgattaagataaatacattggtgcaatgagagaaaagagatttatcttgtacataatttctaaattgacttgtgacattaggaagtcgatctacccagagtggaatttgtttcttcagttcactgaagttcagttcttcagttcactaagttccaactaatttttgtttctccacagtctcaactattttttaaggaaattgcgaagttcacttttaatgtttctgaactaccagacttcctatgatttaaaaaataacaactgtaaatttgcatgaaatctttggcattatatactcaagtatagcttcaattctgggccaatatacaatgctgatttgtgtaggacaaatatctagaaaaataggtatttttgaaaagaagataaatactctaccaatgcaagttcaagatgaaataagagctacatgcacacacacacacaaacacacacacacacacacacacacacatccatctgcatcacatatctcataagcactaagggaaaaaaaacacacttttgtgtttatgatgttaattttaagcaatcaaaagtataagcaataacatatgttttgccaagtttacagtacaccattgtggttataagcatagggatttaagctttgttttcaatagtctgaggtgcttgcattttgtttatatcaacattttacttccaacaatttttttaaaagtcatcttatttgtagtctaaatagttcttggtaaaacacaaaatctcttagtgagtagcaaatcggggccactaaaaataaatttcctctttgttgcaaatgagacaaaaactgttgtatttagactgtgggggcagttaacaaggtctaggaaacctcaacctgctaccccaaaccttttgtctgactacgtggataagaacagatgacaggagagtgggtggcttcctggagagaacttgggctttaactcttattaactgtatttcctagtagagtagcatctgtgcatactagatgtgtaagcttcaacaaatgatcttgccctgagtctgttttattgtctgtaatatgggtaaaatattatatttttatgagattaatttaaggatttgatggcacaatgcatgcagaatcattagcatagaacatatacttgatatttctcaattcttcttgatttccccttcctgtctttctttcctcattttcaaacaaatcaaaataaaactgaaaaagtataaagtatatcacgggaaaatttagaataaaatatattttatttttttctcaacattagaaagtcaactaaaaaatgagcagctatcataccaatacatcgtttagtatagggtagtcagttgacccacacagtaatattaagtcaattcagctgtctttgaataaaaggaaagagtaagcaagcaaaagaaagagagaaagaacaatttaataattacagaggattcttcccaccattctaataatgaatggagtatgaatcacctagcaagcaagagatggcagacatgatttggctttccattcaatcatcacccatcattgaaagatgcttattttcattacaatatgacacctaaattcatgccaactatttcatctgaaactcaaccaagaaaatggcaatctgttctaatgctgaaggaaaatactggttttctagtcttcaacatgacctttcagagagattttcaatggaccttttaaatatacatatatatgattttcttcacacttcataactttagagcttaaattcacatttgtcactctactgtactaatatttaagtacacaacagaatttaacattgtattatcattaaggagcatattagaaagttaaaatattctataaaatatactatataagcaatacatatgttcagataatttgtacttttggttattaaaaagaatttttaacaataggtcatcaaatttttgtagttgaagaaatattttcagattttgcgatttagaattgaaatttcaaaagaacatagacagtaaaagtaaatattagtgaaatattgaactaattagagggaagccaactgagatatttctaaaacaaacaaaaaaactaagtgtatttactacatttgtagggtaatggggaagccaaataattttcatgggtttcagaatgaatgatcaaggtggaaagcatagaaaaatacttgggaacacctgataagcaaagagtaccagccccatacacacacttacatgcaccatacacacccacctgttactcaagttttcagaagtgaagccaccaaaagattaaaataaatattggtgacaaaagataggtgctgctggagtagatcaaggttaatggaggtccttgaactctttgggatatcaagaccaaaaataaaagcttcctttgaagtttgttatctggagaatcagacagacttcttactcttccctggttctagggaccatgtgacaatttatggcaaatgacattagatattaatctttgatatttagtagcatagatcataagcctttttcaaatcaggtagctagaatcatattttcaaagtacaagcccttaatttccgtaatagctacaaaaggtggaggaggacattttattgagattattgttagccagccacccacacacatgggatccaaagtatagtgttctttgcttcatattcaaatctaaaatccagcacatactgagcccatagtgaaatgtgtttacatacacccaacagacgaaagggaggcaacaaaggagactgagaagaaatggctaggattttcagaaacaaaattaggaggctgaggtaatcacttgtctcttcagggatctgctacttcttgaagaggatttatgggatgttacaggtttctgaggcttaccctctgttgtctataactgcttattcatgcaggacaagagaagaaggttaataagtaccctcagggatgtaatactgaaggactttggccctaggtaaataaaaactccaccattttgttcattttaaggctggaattctggtagataagtcaggtaatgtgcagtgaagagctatctatatccagatatcatagaacagattgaggtgtcctagaccatggctcaagatattgcaatgatggcataagatagttggtcaaagaatgaacaatacaagagctgaataaacataaaataaaatgtaggagaagaaaaggaagccatctttaataccagttattataaagaacaaagaatgtgagtgagaaagatagctccttgtaattcagaaaaagaaagaagcaaatgagaaaagaggacataatcagaacttgaggtcaatcagcataataattttagggtatgggtaatcaacagagtaaacttacagtcttattagataaagggaactacatactatgaataataaagcacttatgccatgtgcctcaagcttagaatccagaattggaagtgcataacttaatggaaaaagtccacagaaagtatacaaagctagatagatctatatgtccatgaaatataaatttgtgaggaaatccatgaatcagaaaatggctgcaagctggcagagtcttattggaagcaaagaaaagaaggcatacaagtaatatttatttatgtgggacacttaaagcttttcagccagagaaaatggaaaatgcattactgtcatatatcacaaagcacatataaaagcaaaatatggtaaagatggtgagctttggttatccagatttattagttttttattgctctgtaatgagttaccacaaacttagtggctttaaaaaaacacccatttatttgctcaggattctgtaggtcagaaatctggcacagtgttggcatgttctctggtcaggatgtcacaatgccaaaatcaaggtgttaaactcaattgccatttggaccctgggatagaatccacttccaagatcattcaggtttttggccaaatttagctccttgtggtcttaggactagggtctctgttttccttgttgactatcagccagtggctgctctcagctcttagaagccatctacatcccatgccacctgccacctggttgccttcatcttcaaactagcaactgtgttttgcatccatctcctgctttgaatctctgacttactagtctgtgagcagacagagaaaaatttagttttaaagagcttgtgtaattacattaggcccaccctatcttaaggtcaactgtgccaaaacttaataatgggagtaaaatccatcatattcagagtcccaggaactaggcagggaatgaacacgagggggtgggaaatctcgagggccatcttagagttctgcctaccacagtggacatctgtcgtgggtcttcctcagcaaaagcagaacaaatgatcactggtgacgtgataaactactgacttctccataaggcatgtgagcctccctctgctctgctctgctgtagtcccttgggatactatatcactctctcgtgctgcccttaagagaagcagtaccaaattggaacatgtttagagataaaaaatgttcttgcaactgtgtatagaaggaaagcctgaagggtctgagggtgtttagtgtgtaggataggggtcatagagacaaaattaattattttattgatttaaaatatttgcagtgttgccacaaagtaaatattcactgtgggtctttaaggtgtacagtaacaatgaataggtgaaggcaacaagaaagaattctagtgagagacatagaaggaattactaggaaaaaaattatggaaaatccctggatatacctagctactttatcagatactttattctttagaatataggtaactagaaattaaagaataaaatgaatttatgatcaaattggtaaaagaaactctaggttaagcaagtaagcagccttttcctcccactgcaggatttctcaaagactttattatggtccgtaattctcagaaggaaagatatggcatgcaaaatgtttcaggttaatagaacatcaaacatattttttatttagacacctttaggactggtattttacaaactttgcttggtaaactgctgtgtgttatggggaatttgtgtatcagagagtggttcaacataaccactgcaatctctttttctatttcaggacacatttgggtacttagctagagctgagtcatctttattaatgtgagctgaatatctacacagcagccacagaaaatgagtggtacctatttgaatgcctatgggacttaactggattatatatattctcacagaaattagttagaaaacggtgctcaaaactttgcctcctcaaagtataagtaactggatgaaagatcacctgagcaaaatcaattgtgaaaaacttgttccagattcaacaaaaattattaacaatagtatattagttcattctcacactgctgataatgacatacatgagactgggtaatttataaagaaaaagaggtttagcggactcacatttccacttggctggggaggcctcacactcagggcagaaggcaagaggcacatctcacatggcctcagggaagtgagagaatgagagccaagcaaaaggggaaaccccttataaaatcctcacatgtcgtgggacttattcactaccacgagaacagtatgggacaaaccacccccatgattcaatcatctcccaccggggtccctcccacaacacaagggaattatgggagctacaatgcaagatgagatttgggtggggacacagcaaaaccatatcaaataatgatggaaattaagaaattattgtgatctgctattctcagtaaataattcagaaaaaatctcaatcttcatgatttgtaaatagttgaaagctagtgcacttaatcagcttgggagctgcatcttggctgttctcataaatctcttgttgaggaagttcattgctataaaaatgttagaggttttccctattgcttctttgaatactaatcattccaccttccttttatataacactttgacgaaacgaagctaggactatcctgatatggtgaaatatttctcatagtagattctctgagcttcattatagagaatgttgcagtccaataaattcagcaggttttgtcattttaaaatttttattaaaaaatctttaagataaaatataactaactcttcttagcctcagtataccaaaaagcagatattagtaggaaaaaaaaaatataagggaataccttccgaaagaatctcacaattcctgagctgaaaaaaagtcttctatattcttaattccagctaagcaggtaaaaaaatctagtactaaagagatagcaaggtgtgactggagcccaggccatctaactcagtccaggtctcttacattaggttttagtttttgtaactttgttctattatctatactcctcattatcttttatgtatgtgcgtgtgagaaatattgtaccataaatatgataaatttattttgtaattatctgtcattatataatcaaatgtcaaatagtcaaatgtccaaggtagacatatttagttataatatcatttctagtagcaaaccttgaaatctctaatcatatgttctccatatctatttctcttcactgatgactgattttttttttactaccgtcaacatcaaaatatatggaaaatccattatttcaaaagagcaatttcagaccaattttcaacagaaaagtactcaaataataggctctaatgttcttacatgaatactgtataaatgtgtccatccctgcagaagttcttatcatatcctgcaaaatagcaaagctatcagttactttcggtaaagaaacaatttccattttactctaggcctgtcttttgggttacatcaatgtctgtaattcacatttctaattttaagttaataaaatttgatattcttcctgttaatcattgtaagcatgggggaggatctgaaaaaacgtgagatggggaagacatgttttaataagaaattcctaaatggaacttgattttttaaaaaagaacttgacacaaataaaatattcttaaaaatagaacatctcaatctgtccaaagacaggtaatatccatgtaaaaattctcatattaacccaccaatgtccttcagcctgtgttgagaagcaccaactctcaggttgggggaatagtttatcctcccaggtccactcaattcttggcctataggctgagattgccacctggggagccaattagtgccaaatatgttggtggttttctgatgtaggaaaatctcccctaagaactggactgagatgagccatcaaatgatagtgactttcagtcactaatgatctggaatttagatagagacttttaattgggttaccaagcaacctgcaaatattttggtgatacctgctgagtcaattgggtagtttgtaacccactcttctctgattatgtaatctttgatatgagtacattacatgttataaatgatcagcatggtttttttttctttgtcattagccaagaaaagacatcactgagtcttttgttcattccttgcattatgtttccatgtgtccaaaagagggtacacagagtaaagagtggttatagggaatagagaataagtattcattaagccatcttcttatgccccagtcttctgctaagtagagttagacctcgtgacatcagaaaaggctacaagcaattgttttgtaaatcttatttccacttaattaacagagctggaatttcatgtctgtttcttagatcattttttaaaacataagaaagtgaaatgtgagtgtattgttatatggttttattttaccagagttttattttcaaataaaactttcaagaaaaataaattctgcctctcgttgtttccagatgcctctgtcagttgctgtggtccagcatattcactttttcctgactgctcctgtcatttccttctgtctttcttgctcagctgcctcacatgggtctcaatcagttccttaaactacaaccttgagttgtcttgcccccgtttggggtgggtattatttttcccagtgctactgttctgcccctctggcttttaggtaacatttcacattggctttcaaccttacacgtcgccagatacacagtgggctcttcagaaatgctgccttttccctttgacatgtgtgtgtggtgtaactttcccactgtagacgaagcagtggccagacctttccttctcccagcttttcttctatagccagcttttcctttctcactcatttgaactctttgctggtaggtattcctatgggaaggtgtgcactgatggtctggctttgtgtttctttgagagctttctcctctccctttgagaacttgtaccacgtgagaaataacatcagtagacctaacttttccattcctagttgtattgcaaatgcaagcagtcgagcaaatgataacaaatcatagtgctgtttcaaaggttgcattcacaggacacttagagctctcgactgcatttcaccaatgaggaaaccgagggcccaacatgttaaaaggctagcaaatgttacataattaatagaaagtgactgggaattaaatcttgtctataactcctaatcacatgttttgtacggtacctcatggtgtctcatttgatcactgtattcctgatccagtttcacttgtcactatgtgttctaaacagaagttaaagtggcagcagattcgacatgttttatatagagagatttcattcataaaatacaaaatgaatgacaatattatcaagaagggaaattgaaataaagagaaaaagtcatgtgaaacatatttagttgtgagttgaagctctaaatgcttatacaagaggaaagaatgtcccatgtcattttatgtatcatatacctgtgaaccactgtcaccctgcacaccaaagtgtcaaaaattaagtgggaaaaaatcatacacctaacaagatgttctttcaaaggattatcctattaggtttggggttggagaaacacctttctgttgtatctcaacttagcactggggcttgggaaggggtctagggaaagcccacctcttccttacaaactttcccaaatgtgagttttatgttgagtcccttataagattatttccaagttccttttgagctgaatgatcagctgggttcccattaagagccttggcaaagagaattcttaaatgtgagcttgccaaagtatgaaatgtgatttctgatagttgtttttcctttttcatttttttcctcctccttactcttctctgaccagcctgaaaagtgatacaaaccaggctgggaactacatgcttgcaacagagtaataccctaattatcatcctcttagtaagggctgcttttgacaggtgtcaattagatttaaatggttggctgtgctgttgggttcctttactttccctttttttctacactgtcattccttgaggtagggttaaatgctgacatccctttgtgcttaaccagagataactatcaaagcaatgtataaattacagctccagttacactgatgcttaggaggctcatccacctctaatgacaagatatccaatcaacctgggctatagttttgtgaacagagttgtgaagtttggttaatgaaatctcacatttcacatggttcctgactgtatttttagatactcttacaagtaggatatcctagttagttattctatctttttatctcttgcatgaataaattacagagttctgcttcttatcaaagaaagcattcactcatcatctgggaaacacaaaacactttttagaccataaattattcctaaagaaaatcttagatgagttgggtactccttgttgtgtatgtatatgtgtttgtgagagagaaagaatgtctgcttgatggcattcattctaaatgatcatagacagactacccgattgtcatcttacctgtcagtccttaaagcaaactaccctagaatgcaaacaagcaagccaccaccaaaaatatcctttccaactccttgaccaaccactgtgaatgaccgaatacacccagttcctcctatggcattttcttccggcttactggcagagaatgtgatttcgtggtagactggtagacggttggaaaatgaccccttataatgatggaatttacataaataaatgctgatagcacaaaacagataatatgctgtgggtatcatcacaataagttgtctcccactgacacagagtctaagttggaagcacacaattatgcaaatcaaactaatgccagttgctcattactgtcatggtggtaaaggcaaaaacatatcctccatagacagctcgagacggggccacaagccaaaatgtttggttttgctgacacagtaactgagtcaacaaaaataggatataatagtaatacatcaggggaacccacatcagggtagacctgaagcttaatggactgtgaatcctatgtctgtgcagagcaccctttcactggtattgacccataatacgtctgcttccacatttgccgattatgtagaaatagattacagaagcaaatttttttaagacctgaaatgtctgcaagatattctattagcttttcctaaaacagatgatatgacatttgtaaatacttaaataatgtcacatatcccaggctaaaacacttcccagaatatttcaaagtacctgctgctgtttgatctaggtttgtcctgagttctcattatggcactgaagatgttttcaaacaatagaatgctcatttgccacataaacatctttcctatctttaaaaaaaaatagaagagctgtcaccaggagaatatttaaccctgaatatttcacagaaccttgaaaaaaaatttggccctattgtaggttagtgaagcaacaggtgctgacccaccaatttaatccatttctcttctgaatgacagggtaacatgtggtggattgatgttataaatggccctgatgcttcacccttcatgatattcatgccctttgccacaagattttgctgctcttctcatcaagaagtatctttccttgccccttggctttgagtctagtcatgtgacttgtcttggccaatgggatggaagcaattttgccagaagcaaacgcatagaaaagcatctgcacactgccaagtcagcttatgctataaggacactgtctaggaagaacatgcttggccttgcttgctggagggcaggagacacatggaagagagctaagttgtcctactaaggccggcctaggccagccaacaatgagccagcccctggacagctgagtgagctcaagtcagaaccaactaaatgagtccagcctacatcatccacagattcaggaactaataaatgctgaatgctttaagcccttgagttgtatactgtttgttaagcagcattattgtgttaacagacaactggagagttttcacaaagttttacaatatcaaaaaaatacaagaaaaatataccctataaataatgcaagaaaagattatttagtcaccagatttaaaatacaaacacgggaaaaatggaaattaaatcacaatgagacaccacttcacacctgccagggagaactataatcaaagatagacaataacaaatgtttgcaaggatatgaagaaattggagcctttgtatgttgctgttgggaatataaaatggtgcagccactttggaaaactgtcaaacagttcctcaaaatgttaaacatagcaatactcctccttggtatttacccaagagaaaggaaaacctaggtccatgcaaaaacttgcacaaatgttcatgagagcattacacaaatggccaaaaaggaaacaattcaaatacggatccacagatgaatgaataaacaaaatttggtatatccatacaataaaatattactcagcaagaaaaaggaatgaagtactgatatatgtgatgatatatgagtcttgaaaacattatgctgaataaaagtagccagtcaccaaagcccatgtattgcctgactctatttatacaaaatgccccaaacaggcaattctatacataaagaagacagattgatcattgcagatgtggagggcatgggaattaactgccaaagagtacaaggggtttcttttcaggtaataaaaatgtaaacgtagatcacagtgatcacggtgatggttacacagctctgtgttatgctaaaactcatttaattgtcaataggtgatttttatactatgggaattatatctcagtgaagctggtaaaaattacataaacacttcagcctcatcttctgaccaaaacatggcttgtttcttgttttaggctctcttatatctaccttcttgattggaagctttaaagtgaaaacagaacaaatcaaaagtcttagtattgcttctttagaatcacacacgtatttgctgtatttgacacatttgaaaagtgaaataatgaagaatttttgatgttctataatagacactgatttttcacagaactccagctctgtctttcattttcatgttttctgtgatactcatgctcggcttgctcttaaaactcacctgtgaaaaagaaagggcactacttgccacatcttaggtttgcatatcaaggccaacttcagtgtgtaaacgacacttgcaccaggcatgcttggagctgttcccaatttcgtgttcacagcctctcctccagcagcaggtttgaggtttaacttgcccagttgtgagaactgagtaaatagacagcccgcagtgctgtcatctaagttacctcttctggaacccccactcactgctcccgccacagcttttcttcagctcttcatgatttttgcctaaattaccacattttctggactagctcacttgcttctggtttcactcccctcgagtccactctcctaattgcccccagagtgatggttgtgaagtgggtatcctggccatttcatacccttacaaaaaacaattctagtggcttccaatccatacagataaaagaaaaaatttcatagtataacttggaaggcctttcataatccgacagccgcgggaaatcttgccactccctccccttggagctaataaacatttgctgttctctctcgtgccttcaaataagtgctcccttgtctttatgtgtggtagaggagaagaaattaaaattacaaataaattaaatatattgggagagacagaaatggggagttgctgctcaacaggtataaagtttcattcattcaagatgaaaatgttctagaaatctgtacaacattgaacttagcgttaacaatactgtactgcacacttaaaaaatttaagagggtgtatctcatgttatatatttgttacaatagaatagatgaatttataaatatttatatagatttggatatagctttactgacctctcttcacttgataagccccctcatcctcttgcagtccttttagcaccaactctgccaggaggcctttctaaatctgagatttgtgtcctctcgtattttaagctactggatcagaaactacctgtcctaaacccacctgagcaaagcaccctcgtccatgttgccagcagtgctctatgtacacatgtacacatcacacagcattatcattcctgggttttatttttctgtaaactttttgcatagccaattgttgccagtccatataatgtctttcttttattactgtaattcattttaattagttaattcctgcatcctcattttttcctgccattactctctccctatagccacctgctgtatagcattctttggattcataaacatgtatggattcttgattgtggataagactgtgaaaatgtctgcgtattttacacataattgctattcacctgtctctctgctgctgaattggaagctacttgaggaagggaaaccagccttttcccaacctgaacaccttgcacagtgtctgattcccagtaagagctcaataaatgagtgtcaaatccatgcatgacatgatacattaatgaattaaaagccctacattttagtttaatttctaataatcttggtgggctttacaagttttatctctcttgctacaaatctaaccatgagaacttgcaataagcgctaaaaatcttaaaatatgagaccatttgaatctcagcctcttttgctgcccatgtcttccttctctggcatgtccctgaagcactctgtcccaactgatactagtagatattttagaccatctagtggacagtagcttaaatgtttgacagatttctacttctttctcaaaatggttgctgattaatagctgaaaggatcaaccccagagggaacctgaggtttcctacctgcccaaagccagctttcacattcccatttcccaccagaggactgcaaagatttttcccttgactttgaaataacacttggttttacagtctgcttgcctgtggtttaggaaccgagcatgtcagcactcctttttactgcctcagtgcagcagcaaatgtgttctgttctctcctttcaaaagtgaagattgtattttaaaatcactcttgcccctagggagccactcactcctaactccctgacaggccatgaggacctcaaaattaagaaagatgtccagaaatgtgagtttgtacagaaaggactagaaaaccacccagacatgtaacagctcggttacgtgcctggcttctgtcaggagaaatgtgtgtctgaattttcaggctcataatagacatgtacagctaaccgacttttattttgcctctgtcatattgatctatcagtgaatctataatagaagatgggagcttggaaaagtaaaaagtaataaccattgagatggatagcctgagcagaaatgtagtttcatggggacacttagtgcaaagaactgtagattcatgtcaagggggcacaagtatccccttcaaagccaactgttaaaaacacctagtgcacagatgacctgccttcagaatatgatatgtttctgtattgattttcagagtttcagaacaacaggaaatagccaaatgaaagtttctttgcagagcactaaaagtaatttaccttctgcctttgatttcagcttcagattttgttttatggtgcaaagtacaagtgcttattttaaaaaattcatttctaacttatggtggaaagcagcaccagagaccaaggaagtgtggagcaagaaatgagccatgaaatgaaacaaagcaaaaccccccaaattgcatcaatggagttagtggtaagtcattacacaatgaagtttgtcttttaagcacaggcccactgattggcaggcaggattttaccattatcagaatgaggagcctataaaatgcccaaaactgtggctttgaagtcatctatatttagcttctgtaattccatcttttgtacatccctttgcatgaaaaataaagtgtcatattcaaataaaattggccttccaggacagaagaaaacacagtttactttccagtacaagttggtaccatttgcacatgtttggtctacaataagtactaagcatggggcaatactaataatttgtgagtcttgactagacctctttttttaaagagattattcactttatattcaaataaatttggtttatacagtatatgatgatgcaaggaaacaagtttcagcttattcaatgcccaaacttgaaatttatttgtttccattgttttcttcatttggggctttaagaagttgcattaagcagagttctggcaagaaacagaactcaaaagaagcaattaaagagtttcaacagaggcacaaagcatgggcagggttaagggaattcaaccaaggagggtgaaacaagcattcctgaggctcccaaccaccaccacgtctgaagtgaagagagaagggaatgtttaaagagtccatgcagcctgagtctgaagggaaggccacccaacaggagctggggccgatggaagaggagctcagacactgccaatccatgaaccgagggaacaaacaccccgacttttctttcttcatgtcttctagcttcctaccaggggctcctattgggtgaaccccactgaaaaccagataaaaaaagcttagtttcacagtctattcatatcagcctgctgaaacatacagccaagggagaaagccccagagtgatccagaagggcacattaaaaaaaacaaacaaaaacgaaacaaaacaaaacattgtatcataagagtattttattctagatatgtgctctatactcatagaactggcaatataattgcaattcttcaacttcagcagaaaaacaaaaatgcagctttttgctgcacatatgacataccctgaccaagttaagagagagattcggctttgggaagaacaaggatgaagtaagagtatctataagtgggagaaactgttaagatcttccgaaatagaagttaaacgaaattaaacaaagcagaacaaaagcaatggatatctgttaacctttgccttccacttcttagcaaataaaacattacagcaagcataaatactgtgaaaatactcccaggagccatgggaataactaacctcttcctcactctctgctcaaaaaactctcctaatcagactattggaatatgccccctagttagtaagaaaaacaacaggaaactgggatttgctttaaagacatttaatcatagactatattttaaaatgtgcattatatccacaaaaagagtgatatcagtatcatatgtttgtcaaaacaaggttaaaatgtatatgaacttttgacttttccctgtccaaatcacacccttgtaaggagcccattttattgtaaacatttaaatctgttaggtattagatatgagctcagttatttttgttttgtgtatttttttattcacagatgtttttattatgctttctgcaatcaaatgatctgggttagaattagaggattagaatgccattggatcttactttaaaaatacaaatttatctattttcattaggaacctgacattcttatccagaaaatttacattccatactgaatccaggtattatgtaacacatattggttgtatttttttaaaaaaagtaacaactacttccctacatagataaaatatctatccattatccacctatctatgaatctaaatttacaatgaatcaagtgccaaaaatagcctagcctacttacagagttctctctacaattgccagtcactggaaaaatattcacaatcctttaagtccattaggatggttggttctcacttcagataaaatgataactatgttctgcccaaatttgctttgctttcattctttgcttgcactctcaacaaaaacaactttttaaagcttgaatatttcatgaacagttttgaatggcttcaattgttctgtatttttaaagtgcagataactgtaggaaaaatatatagctaaagatgtctctcgaagtatgttgacactccaatttcattagaacaggattaaaatgtatatttacatgttgtgtgtaaagaaaataccagctttacagtggtaagtatatatgtgaaggactcatttcagcatatgactatacatacacccacatacacatgcatagacataaacacagacacacatatgcacacatataaacatacacttacacacataaatgcacatatacatacatacatacacatacatatacatagatatatacacatacacctatatacatactcatacatagccagccataaacacatacataatacaagtacacaaacacacatatacacacatacacataggcatacacacatatatacacacatacatacacacatatcacatgcatacagataaacacatgcacacatacacaaacacatacaaatgaacacatatacatacggacatacacacatatacacatacacatacatatacacacacacatccacatccatactcatgctgacctgggataggactgtgaagaaaaaagataggatttgaaatcagaaagttggcattcaaacctgattccacctcttcttaattataatcttaaacctacactaccttttaccctatcaattacttctctagcaactcccctgaaccctgtgctctcatccataacttatatatttgtaattccctgaactctctgtataggcatctgccatcactcatttgcttcctaagtaccattgccttaagttcgctcatcacttgattttgttaacttgtctcttgtttcaagtctcagctaacttgtcaccttctctaggttcccctcttgaatttctccaaactgagtcagatgactgcctcactcttactctcctgtggccactgtacatatctcctatatcacagtgctatcccattgtcttttgaatttctgttaccttgcatgtcttctccactggatcaaaattctttggaggacagcaccttttttgtctactttcatattttcagtaccttatatggcacatagttagaatttcaatgagagttttatgaataaatgaatcttgaactcactgaatttaacttttgactcccagcctcaccaaatctttaggtactatcctttcataaagaaatgagggaacataaaattccaagtgtttcagaaacatgctaaagtaaacaacagaaagagtggagcagaagttaaacccaaggctgtcttacttcaaagactgtactgtgtcatgttccctttccaggtagttctccaaacctctgtttatcagagaaatggggctaagaaaactgcccaccctacaaggctgataaaaagaaccagagaaatcatgttagttaataatttggaacagagttacagaaaagtctaacttttttattttacttttacagaggaaatatctgtaaatagcacagagaataagtgaatccgaagagatttcctggacacgtttccttaccccaacttacaccaaaggttctctttaccaagctctatctggccaccttagtttccccctagcatgtgtgctaagcacagatgcactcctagagtttatataaaccagcactgacaaggaaagtatagaaccagaatgaagagtatgaggctcaggaaggctgctcattctatttgtctgcaaaatgccatcagtttgcagtttaaagagagaacaacataagtagagcaaagttcaattgctctccaattagccctaattaacgaattgaaagctgtttgtatataaccaaagataccttttgttttgttgttgtggttcagcaattgagatgagtagtccaagtgattagtaactaccagagaagaaggcaatttggggacaagtacatgcaattttagtactgttttatggggtaaataatgagtttagaaatgttttcactattttaataagaaaaaagaattttaacaaacatggattatttgtagctatccaaaggcaataaaatccaaggcaatctatggaaattagtcccccatttttgcaagacaaacgtgtgaatcaattgtattttccaatgctctgttgagaggaggtatctcagaaacgcaaaatgcattacttcatattagcaatgccattcctactgacaatgtaactttcagtggctctaactcgagtccaaacacacgttttccacaagagtcccatgggaacttgcaatcaccttttcatacccctaagttggtgcagatcaggagcaagcccccctggatgctaaagcaggagatccttctctctccttcttccccaactgtcgtgtctataacttacaaaatcaaaatggagtttttagaaacaggatgcttggactgaagacaggaacgtgggatggggccctgacaggagcaggaatcacatgcaactggaggggtcatcaatgagggccaggagctgtgtgcttcctttcacactgtctatccatcagtaattttcacctggtgctcagtcattttctatctattataaccaaattcccagccagctcagaatgggctggccttgaatatccctgtctttactgaattctttctttcttaactgacgctttgtggttgaacagatgcatcccagatgtgcaaaaaatagttcacattcacagagaataaagtcctggctcattaaagggaagacaacattccgtcctggcttagaataccaagatagcatttcccagagttgacagcgaattggaaaatttaacaaaagccatagaaatacttcctgggtcaccaagaaagtcataacaagagaataccattgatatgccacccagttccaagggcttcccttggcacttagcctcctagccatttcacacatactcacctttcctgactcctagttagacctcgtgttggtacccatatacctttttttctggttcagaaaggctggccccgaaaagcagtagcaaagctctagctctgcgtggtggcaggtgcctgtagtcccagctactcaggaggctgaggcaggagaatcgcttgaacctgggaggcggaggttgcagtgagccgagatcgtgccactgcactccagcctgggtgacagagcaagactccatctcaaaaataaataaataaataataaaaagataaaaaaggaggaaggtgaaatgggtgcatgcctatccttcactaggaaagcgattatagtggtctgggaaaacagaatgatgctgaagttacttgagaaaggaagtaccaccatttgctgtggccgtaatcaagtctgtaaaggctgcaaagggtctgagcatgttcctccaattatcaaaaacccattcacaactcaggaactctcaagaggttcctcccttctctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagttgactaaagaagatagaatgaaaaggaaccattgcacaaagatatgtttttatttgaccaacaggctttattttgattccccaatcttctggaactcagactttctcagcaaacaattgcactgcccactgagagtaaacagcaaacctgccaatatcacaatataccctgagatgaacacgtgtgagggaaagacttcatatgccagacataatcctgatggttcccaaatacacactggttcccagataaagtctggtgactggctaatgcttttcactgtgattaaaagcaaatactttaaaaaatatttaatgattcattattatatttttctgagtgcttaagtctattgtctcattattgtttgtttattcgtagtttgggaaaattttgttgggacaaggtaacaagatagatctcagctacagccagaagtcataatgttcagacacacattaattctgtggacaatatgagaaaatgggagcaacaattaccctataattagggttgtgaactggggaagggcaatgtccaatatcacagagggagggttgaaagaaactagagatttgacagaaagtgatcaagctcacaaacgtatctatcattgcctcattttttaatgttttaggtgaatgaatttgagtttctgtgttgagcaatgacttgaatatttcatctcactcatgtagcccttgtcacaaattatttttcctactttagaatctactggactgctataaaataaaactctaatgcttggaacaacaataacagaaaccaaaattttatgctttgttcttttacaggccccttcaaaccccaggaacaggtgctttaaattaggctgccgaaggccagtggggcctggctttattatactttggtaaataatagtcactgttgtcatcagagttctctacacttccagaaaatgtcactagccacatgtcagcagggttctttgtctaatttctacagctaaggtggcaagaaggttattagaagtaatagcaaatttaaagttttattagcagtaaactgcaaaagctaatggtgatgccaacactagataaaatcattgtcacagttaattctgaactccttatttcaagcttaataataggaaactcaatggaaaggatattacacgccccatatcactcatgagtgcctcaggcctgagtaacttgttattttgctcatgagtgaaataaaatgcagattatactgcctgctatcaggggcattgttttaattgagggtgaatgcatggtgatgaggggggctccgagtaggttctcatttttgtaaatgttatgagaatattcttctcatttgtaactgtgactcagcacatcacctttctattacttgtgggggtgtgtgtgtgcttttagagttacctttgtttcagctccagagaaatgaaagcagctggggagatgggagggtagcatttggtgcttctcaccagcatttctgcaaaagtgcctctccagcattctagcgcctttgtcttcaatccctcagtctacagaggcaaacaatggaatatctgtgttgctctgtttgtctcattccaatcctgtatgccagcacacacacacacacacacacacacacacacacacacacacacacacaaagcccttccactctgatatacactcccggccaggaataaataatacaagatgcactcctctgtgctttacatttactaagaaaataggtgtttccgagaatcaagatcacgtgggattttgtgttctttttctaaagtatgttgctctttttttcaaacaagttgaagtgatttctgatcctatgccacaaatcatccaaatgggctgccttgagagccacgcatgcattcctgctttaaggggagccttccattcacttgacacggactgtctgtaattatgcagggctaacttcaggctgcagtgtgcgtggagacgactattttgaagcaggtcctattccctttgattgaagttgaaatcctaagacttccacagccgagatcatttgtgcctctctgagtttcaatattccctttgaaatatttgtctgatgatacaccgtatggacagagcctcctacagttcagtttctgagcaattatcactccatggcaatttgacttcatgtagcagtggagaaataaaatacttaaggctgctgccagcctgcctaacaaagcttttgcataagttaaagactcagaaaggggtgggaaacagtagttaaacctttgctttatcttttaagtttgtaaaacatataaaatctgagttcaaaatcttagaggttgtgacagacttctccattagcaggtgaaattagcccccaaattataatcttgattgattcaataatgttcaactagtagtggaatgagttttattttgaataatttcctcactcctgtttctctgcatcctatttcagtttgcagtctgtcctttaaatggcatttcctttttgccaaagcaccaagctgtgaatttattgagaaatgggtgtgtttacaataagactatgccattaccaataagtcccattcatatcagaaaaaattaaacattatattcctaaattgtaaacaaacagtcctaaattccagagattattattcccagaaaggcaaagtacagagccaagagaatttgtaaatatgtacaactttacaagattgatatggacaccgatgcatgttgcgctcatctccacttatttcttattcatacacatcattcttatgtttgacaatgaatatggtattgtggcacttgaaatcctttttttattaaaaaacagaaagaatgtcagccagttaaacatgatattaggatttcatcttatttttttgttttgttttgcagcaagagaatttaaaagaaccatcaatcctctctaaaaggtacttttaataaattggcatacctaattttgcatggatgccatgatgtctggcctgcttctatttggagtctcttgggatctatacagatttttaatagtcatgagaacttgtcttgtactgtggattgtagaattgtcttctattatagtcagctatccactctatttaagacagaagtttcttttgctgctttcttggagttgtttgatggtttatgaatacataaaaatctgttggtaattataggttaacgtaattagcaaacattttaaacttaatgttttcctaggaacagtttttgtcactttttcatgattgtttaaatattatatctttaaactctgtaataatttcatctaagcaaaagccttgatctttaaatcatttgatgaaccttaactatccatgatttgtttcaaaactaagtccacacggagacttcactatgccatgtgcctcatctagttattaaatgtgtgatacgcgtgcttcttaatgtgtgcatattagctatttttaaattataattttaccatgaagaaatgaataaaacttccaaaaatgtctgtctcagtggaatgtacactatcgtagggagatacgtatatatatagtatattggttggtgataagtgtcatggagaaaaatcaggcagaaaagataatgtttagggagagcctctctgaaaagatgacatttgcacaaaaggccccaaaggaagtaaggaagcaagccatgcagctagggatgccatgcagctagccatgttctaggcagagggaaaagcaattgtcaaagcattgagacaggggcctccctggaacatgtgaagagtatcagggaagccaatgtggcagaggcagtgggagtaagaaaaagagaactgcagtggatgagatcagagaaatggtgatggtagagaatgtgtgtgtgttgggggggcatccattgagtggcttctactctgagtcagatgaacagctttcaaaggatccttagcagataagtgatgtgatctgccttatgacttagaaaagaaaacctgagctaccctgagaatagaccctcgagagaaaaagggaaggaaatagacgagttaagaagctgttgaaataatgcagatgagagatgaggaaggtttgtattatcagtagagatgggatggagaagttacattctggatatatttagaagctggggtagataggatttgccaacaaattggattaaaaatgtgaaagaatgaaagtcaaggataattccaagtttttaatctgagcaaatggaaggtcagaattgccatttattaaatggagaaaagtttgggagaagcagatttggtggaggcaagtggataaaggtttgaacatttaaggatggggttgagtaagcaattgcatctagaagtctctatgtcagggagacagcttttgcttcaagattttgaggccatgagaagaagagaagaagtccaaaggctgagttcttagacactcattgtttagagttcagggagataaggagaacccagcaagcaagactaagaagaaatgatccgtgaggaaggactggattcaggagagtgctatgtctcagaagccaagtgaagaattaaagaaatgaagcatgacagtaaaacttatacatttatttctaaataaaaataatctattcatcaaaatagcacgacatttaatgtgtcgataaatatatttaaatttaaacaaacaaattctactttgaaatctaaattgagtagtataattgttgattaaaacactcaagagattatattcaaatccctactttatttattttacagtgccatgaacattcaaaagtttgacccaattctcttgagattccaaaaattattttcaaattcttttggtctttttatagtgtaatatgtatgaaatatcatgtttgctctggggtacagtattgtttttaatgctgggcactgtaaaaattctcaaattttagaattcctaagtatctgctttttgtttgttcttggtttatattttctgatgtcaaaggtctcatatttgcatgcctattctaggcatggattgtgggagtctgagctttaaaatagtccacaagaatcattttgtgatttgggctttatctactgcctttaattttaggcatcaattttgaagtcatatcagtagccttaccacttgaagtaccaccaagtaggaggctaattttatctaagaaaagtgtttctacttcctttgtttttgattttggtgaagacatagaggggataggaggataaagtagaaagaagtgatttggcaactatcctattagtttaaatcataattagacctaactgcataattcagaacccaagttgagtctcctagcagctcccttaggggctctggggctgtcccatcacagaagccctccactgaacttcctccccagttgctcccatgggcacgttgccttgtgtcagaagtcagagtatgtcttcttccagcttgagtttctagcttctaaatatttgtagcagactttaagtggcaggataagtggataaatgaggaatatatcacagagactcacaaaactgctcaggcccaactagtgcctatgttatcagctcctccaatctctgtacttttcctttgctagagacatcacacccacaactgcttttcaatgcccttgccacaaggctctgagttccatggggacccatgtcttatacattgttatattcctggtatctgacaccatatcaggcatactaagatacttttaaaataaagcatgagaggcccaaactaccttgtttaaaaaggcagaaaaaaattgtaaagaaggatgacaaggcgtgaatatttttcaagtcacaatcataaaaatttttataaattgttattgatatatagattatatataatctatttatattagattaaatataatctggcaaataaattaatgaatggatctcatatagtttattttaagtagaattcatagtactgaggagaagtaaaatcaccagatacaaaattaacagatgttttagtagcccaaagtgtggagtaggaagtatacgttagtccattctcacactgctataaagatactacccgatactgggtaacttataaaggaaaaaggtttaattgactcgcagttccacatggctgggaaggcctcagttaacttacaatcatgatggaaggtgagggggaagcaaacttgaacttttcacatggcagcaggagagagtgctagcaagagcagggaaaactgccttataaaaccatcagatcttgtgggaacttactcactatcacgagaacagcacgggggaaactctccctcttaatccaaccacttcccaccagggctctccctacaacaatgagggattacaattcaagatgagatttgggtggggacacaaagcctaaccatttaagacatcttagaattctacctacctcagtaatcttgagagacaaatatctgttattttcacctttgaggaaactaagatttcaaagatttagctgacttgcccaaggacgtctacctgagaaatgtttcttactaggaatgtccccaggagatattcggcaatgtttggaaacatttttggttgtcacaaatgggaagaagctggaaaacttttagctggcccaggttaaaattctattagcatgtaagaagaaaagaagatatcaaaaaagaaggagagaacatatcaaagttgcttcataattaatataaagtcagatgctccaggagatgtcaaataatttgcccatgatctgatgatggtcaacttactcaccattaccttgttctttccagtaatgataactcacacttttcttcatagcctaaatgaaaaagaataacataaagcaagactcaacaaactaagggtcttcttgatactaataataaattagaagttcaagttccctatgagattaacaggctcctttagagaaagcacattattaagtacatgtccttctaagtgatcaagatgtaagttttccttgcagtataatgcttttaggcggagaggtaacagactccagagaccggagggagacacaggatgagaaagggaggcaactgttatgatgtgctatacacaaatgtgtgacagtctcaccccatgaaggctcacagctctccagttccttttgatgactgcctgtgtggccaaagtttaaaatagacttagtataagtgagtgctgtgccacaggaggagatggaagaggatgagaaaattacaaagtacaatgtagacagcttagctaggaagatgatgttgacatagatgatagatcaatcgatagatagatagatataaaaatggaaaacaggccctttcctcttaggcactacattctctgggacctttttcaagaccatgtgaggtcagcattactagccccattaacaaatgagagacaaagaatgctaaatatcctgatgtaggcagcaaagcccctacctattccatctggcccagttgcctctataggcttactttgtatcactctctttctcattcattcagctccagccacactggccaccctgctgctcctcaaatgtaccaggcacatttccatggggcctttacactaacagcttcatctgcctgtggtgctcttccctgaagatctacagggttcattgtttttctttaggtgtcttcaaatgtcaccagttcctctctccctcttgatattcctctactccattccctgctttacttctctttaaaacatttctcaccatcatattctacatcacccatctattccaatcctgcccccaacaacaaaataacctgatgtaagagcttgcatgtaggcagtgtattttgcaagtaatgccaaggaacaaaaatgggaaaatgggaagagtgaaaagagaacaaaagcaaagctaatctagcagtgcattatcaagttggtgacaaatgtgggtaactagggctcaatatgattaggggtcctctgaaagtcctgcataacacatgtcagaattgtctaccagagttacaggcttctatctcctattctttaagggtaatcccatggctgtgttaggaaagattcagaatggctgagcgggttcccataagtgttccacacagaggaacgctagggcaaaagttggagtgaggtgttagctggtcacacctgcaatcagctagttgtggtaccaatgtctggaataaaatggtcaaccaagaggttgtgaggtaggatataagaggttcatgaaagagtccagcttttgcaacactgagacttctcccagagccttcaaggcagtgtggccagtactgatttctacaatagactcgataaagaaaagctatttgggaaagggagtccctgctaccaccaggccgtcactgatattaaccatcttttttcctcctccaatgtcattctaagttttccctattcttagtcaccactccagttggtctaaactgctttgtctggagagatggctcaaaccatcatctacatggggttagaaacctttattactacaccacagtcaggtcattgtctttacaatagtccgttttctgttatcatctggacagccccaaggaagctcctggtttctacacctgctcttccatggtaccaccaagcagcaccaccacgaggagcaaccatagctcctcattcaaatcaggctcagttatccccaccaacgtgatgacttccttctgcttttggggccacttgcatgagaagcccaaaatggccaacaatggtcatagttccaagactatgacttattctgtcctctagtgaagtatcctcctgccatggtagaaatcagaactcctaatccatcagagcctagattgtaggaaggagaagcacagacatcactagtaagtatgagtgataaccatggggccaatcttttacttcatggtttctaacccatgtattctagctttggggaggtcacagcaccatatgttggccattaatttggggcatacacacttcctgaggaaagcattccaagcctacatagtgtagtccctaaactggcacctcggccaagcccccaatatatcttcccatcattctttgaggaagccacaccactgtaggtaagacccagtacttttcaccattgtattccaacatgtagattagtacctggcacgttcatcactctgaatatatgaatgaattaatcaaccaattattctctttagattaactgagacattcaaaatcaaaaaacaaagaggttgaaattcattataaactcgtacctcacattattaaagcttgaggaatgatctcttagatacaaacgtaattagcttctatgatgttgaaaaataaaattaggaaaattgaaaaattcacactttcgtaatgtatgtggaattaatctattaatataaaaaccatacttatttggcataccaacaaatcatacacttggcaacataggggtacaaattcacttatttttctttgtcctgaacactaatgaatttcgtgtatgaaaaacttcattaagaaacattgtttaaaaacaaattgtcaaaacccgactctaccagattaaatgtatgttaaaacatttaagatgacatttattgcatcaattttttaaataatgcttgagaaagctgtgaacataacttcatagcccaaaaccttcttctctttccctttgtagcatatttctccgataatgtattttgcctactgctaccaaagtaccagaaaataatgcctaaaagaccaaaatgaagtgtttcagaattaaggagaaagttgtaaatttgtaatgttttagacacatttcagtttagcgcttgatagatcatgtcgggttggttgcgagagggatttcaagggcttgggaaaataaagtcagtgtatgtgtagtttcatttttgagagaatcactttattactgatcacaggacagttgttgagctctgacagctctaagtgctgaaaacattagagaaggtccatttttttgtttttgcccaattatgaactgtaacttggtgagagaagcaatagaatctatttacctaacctaatggtaatgcttcattttaactaaaatgtcaacacatagtggtctctgcacgtatttcaccagcatctaaattccaccatggggttcaaattttttaaatgaaatcttagacccttggtagaaaaagagccaaggatttatatatcaatgtaaaaatggcctatcttaaaatatacttatcacaaatataagaaattcctaaaatttggggttttcttctatggctttctcaaaggtcagaatgcaatgtttctattcaaatgaacaattcaactagttaactaatacgaagccccttttcttatcttctgctaacctctcacctttgaaatcagttgtctaacttcaagtgttgccttcccaattaatgaagttatctacacaattttcaaaatgtgactccatgtctatgagtttgttgttaatattactggaaagacaatataatgtgaaacaatagcaaaaagcaaaaattgaaggcactagcaccttctttgtgggacaggaaaactaacaaaacttggtgatttgtattaactcaggaccacagtaatctcataaaatggctctttcttggattttgcaagatggtttcattatttagtgcaccaatcaaaaagatagccaagtttttaatccaggccaattgaaagcaaacaatcaatgcaattaagaaactaggaaaaaaaggagaaattctgatgtccagcacatatattaaacttaattatatttttcatgataaagtaaatttgctcagtggagtctcaaagtatgttattgttataaattattttaaagttttcaaagataactttcaaaattaaagttataaaagatgactcccattttctcattttcctcctcagtttttaatgagcatacatttctcacttcatccattaagaaatgtttgtggtttaaaagttcatgttgactgcaaaaatggtgatagaagaaagctctgaggatattgctataaagttaataaatcatcttcactcatcaactatcttcaacccgcacaagttataaaggattattttgttagcaccacagggtacacaatttaaatttagagaatcagccctagcagaataagtttgaattctggaagcttctaggtccccttgcctttaaacattatacgcttcagagtccttacattttcaattgacagagaaacagaaaatcattctaacgtttaccgtagcttttccctctaagggcttcttgcaaagaatttgcatgttgcaattatacctcaaattagagatttgagtttccctgcctggtcaattataagacccttggccttaccagagaatgaatacacgctctcaactttgcaaaggtctgagtcaacagcttgttgggctttgaagaacctcagccgtttttgcggctggagctttttctccttttcgtgtttcaggaccactgctggttttcattcatcttcattcagtgggtttcatgtgacattttggggctggaaacataatgtgtcagaagatagctgcagcttcctactgcgttattgtttcctttgtcagaaggtgagtgagcacaaacattttccaattgctctgattttcagacaggtttagatctactgagccatcactgatgcacacgcctataccatttagaaacacttgatatagatttcagaagagatttctaagttcagttctatacaaataaatgtactatcatttatcctttttccagaagaggcagagatttcatatcctctccttggtttaccccgatcagtataaaaggaatagatacggtgcttcaaaaacacttctcatttgggttcaaaaacagcagctcacctttctgctggaagcaaaacattatcatgatcaacagaatctgtctgttgggattcagttctgcaatcctttcatggatcaaattcccatcagaatcagaattaagtcctaagtgaaaacttaaattacattataatactcagcctcataagttccaccaaggctttgccaaaggcattgaatgatttatgataaacttcagaacctcagtcccctcttcccagggtgtcttcaattaattctttgaagaactttactcttgattccttgttgaactgaagtaataaggggtttaaggcctttatatttttcctcgaactttctcttcttaacttagaatatctgcaagtgaaatataattgattggatctttctaaatctgtcttttataaaattatggttaaatattatcttattcctgcagaatttatatgacttttaagtataaatctctatgtcatcttagttataaaaatcatatcattagaaattgccaaaatgcattacacttcagcctgaagagtaaggttcctttcagttagaaaatagctccccaggaaattccatgttggtctgtatttgattccccagccgcttgggatgcaaatgcatgccattgactgtaataagaattggatgtatgtctataggtagactgtaaaattttaaagtttgatttgtctcctcatatggagaaactgaatcctaggaaaatttagagacatttcctagatcacacatttcattaaggttagtgtgggttctctttctattatggggtgtggcatcagaaaaatgtggttttaaacactgggtcaactagtaatatgccttatataagtcatggcatagtctacttagtgatgccatgaataacccactgagcttcatattcttaactagcatattcttaacttatctatattctaagatagctgagaagatgaaaaaatatgtatataaaaattctggccccaacacgcattaaatgatggtaaagattataattgttgatctttttatgtaactaacctcctaaaattatctttctgcccttttctccctgattcattcttcacacagcttatggattaactatctatagcacaggtcttagtatgattctctttactttaaatattctcaatggcttcctatcatcaatgaaattatcttaaaatttctcaccctaaattgcaaagccctgcgtatcaggctgcagcccacctttccaaaaatcattttaactgtttttctgtaattacactattttcatgtctagctaaattggtttacattccacagacaattctccaaatttctaaaaccaaaattccatctcccctataagcgctttatttattcttccaaccagatgcaacatttcccacagaagtggggaagagaaaggaaaaagcacctactgaatatattttctgtgcagagttctttcttctgtgctgggcactttaaatttgttatttcattagtgcttctcttatgacatgttatcttttgttataacaaaagacatgtttgttgttgtccattaaagctgtccattaagggcagaaataatgtcttaatctctagcatagaatatttacaagtagaaggacttagggggaaaatgcaaactgaacaccttaaattattatcaataaaagcactagccagaatgaggagttgaggggcatttgaagcaacttggaaaaccatggcagcttatttggggtagaaaggccctcttttatccatcataaatcatcatcagatttatactttgttagcaaaagggggctgaagtacaacatgtcatatagtgtgttgcaattgtaacagggcctcactcttctttcttcttcccaaggcctaatcagttacataaaaaaagaaagaagagaggagacgagagaagaaaagagaagacaagagaagagaagagaagagaagagaagagaagagaaaagaaaggaaaagaaaagaaaacaaaagaaaggaaattaccacgaaaccagtcctggaaaatgtaaaatgttacttgcatcatcatgtgaaaaagctcaaaagatggaaaaatattttctaagtacatttatttggacataacataagtatcttccaacatattttagcgatggaagatgtggtgaattgaaaagatgagttcagctctacatatgctttatggtcacaagttgccacttttaaaacatttatatactcttatgcatatcatataactgaacatgaatgttagcatctaagtatatgtatctgatgaaaatgccagagttataaaatcttttttatgtttttttaatcacaaaaatatcaaaatgcaccttggttttagggaataattttctatcactggtcctgagaacctctaaaattatggaacaatcgttccagactctcaataccattaagttcaatgaactataaactccagggcaaagaacacagcttttttgatcaacaatgtatatttaacgtccaagcttaatgactgaagaaagtaaactccctaaaaacataagtttttttttaatgaatcaaaagaaaaggaaaaagaaaaagatatttagaaaggacccatagtttgtcatctgaatgcagcagacatttaaaatggactctatcttttcaagaatatgaaatctactgacccctttcaaggggttcccccacctttcattgcctccctcagcagaggggttgctggatgccattactcagggaaacagttttgattccttcctgatcgcctattatctctcttgttttattgaaccagggtctctctgcaccctggcagaagctggcaattcatcaggataccatttagggaatcactgtgatgcttagtttacagtccacaaggcagctactgggagaatctggatcaatgtgttttatgcctctgaaatttgggcagcaaagaaagagtgcttcagttataaacatgcaatgtccatagttctcatcatccttctgaacaagcagaagctccccttttctgaacccaaatggagcaatccaattacaaagtcattaaatcccgttataaggtggttcataggagttcctgtttccagcaaaagccttttctgtgttcatccaacatatattctggcctcttgcactcagtttacaaggtttctaattaagctccagagaggatgatatagttcactgaactgagtcactatgctacaactgggaaagaagaggcattcctattttatcagaaaaataaacactttagtttcatttcctctgccacacatgttatctctttgtgctgtcacaacattttttataggtttttatttcaaaggattaccttgagattactgtcaacgcaagccagagagacatctccatacagaatataggggtaatattttttctcctaaaacatcctgctacagacaatataatatcatataatatcaccgaaataatctcccctattgagagcaaagagacagttttcaatagtactttggtacaaaatttgaggaaaataaaatgtttatcagtgacaaaaatacaatttaccagcttgatttttaagtcaaaaatttaaccttttaaacgatttcagaagctccgctaatttctactgttccttgtaacatctgtaggcaaaatacaacatgctgggtcataattcatagcttggcaagaaaatgttgcttaaaaacataaaggtccttttctttttatgcagaggaaaacattttagttattattcaactcaagtaaatgctcataaccatggaattaaatatttctgaagggttcattcctgagctttcttctgggttgaattaggctttctcagaactatacttcatgtcacccacatgtcttaagaactggtgccttctgctcagctgtgcatttttttgcagacatgccggatatctacgcagtaagtgctctgaaacttcaaagagacacagagcattctgtgctttctcttcccaccattccatgtaaacaccatgaataaccagaccattcttatgccaaaaggccctgatggcttgactttttggtccgttaattgttcacaatcactccttgcctgtattgtgcttggtaggaccacctttctgcagccaaaatccagccacttaccactgcatatacttcctacagcagaatagatactgaccaaagcctagtagaaacctgcatggcatcctgtctcttaatacttaatgctaccatgccctcagagtattcttattcagaatctaaacaagcatgtattcagaggctacaatgtatcaggcattggtggtgttagcagtcatagttcagtgaatgggaagaaagataaaaatccatgcctcccagtgactttaagtcctggtagggacaaatacagaagataagtaaataaacaagataactgtagatagtaataggctctgtaggcaataaacctcaggataatgtgatagagaatgacttggggattggtaatacccagatggggagctggaacaccgtccagggcagatggcatttgaactgaaacctgaaggaaaaaagaatctggacagcctcaacaccagatcaaacagtttttgaaacatagaaaacaagaacaaagcccccagtgggtgagaggaactgaagaagcctagtaggatggaagtataatgatactcatacactggagaatattgctaagcgcaaacaattctaagcttgtgaaagttccttgtgattattctatatttctttgaatcatattgatgaaaaattctttgtaataattcccatccaaatgtgacttcttgggtgcaaacataattttcacaacttatttaaaagcctatttaactttgcctatagcatgcttcacagaaatagtaacatccatcttacaggactttcatgaagactactatgtacggcagtcctcacttttttcctgctcaaaatcctgtctccctttccttttaaaagaacacagactttgttcgtgaccataatgtgttctccttaaaactacatgcatgcatgcattcctacacatatacccacaacctcaccactgcttgcagctagtgagttggcaagtatggcacacatagcacagagatactaatgagatgtgaatagaagatagatcttaaactcacgcattgtatttccctttactgttccctgtctggaaaatgaatgtgatgctaaaagaaaggcagccttctgtgaccctgaggtagctatgagaagttgcatatttggaatagttgaatggacagcttacaggagctgtgttctacatagatacatagttgtatgtagccaaatgcagaattatatgtaaagtgccacaaaacaaatgtaaggtaaatagtagtgtaaggccttcattatcatttatattactggtgtgttttaatgaagcattgaatttatttacagaaaaggatgctaagctgagatattttaaagtcaagctatataagaatttgaagggatatttaatataatatctgcttttccaccagccatcaatctcagcaaactcacacaggaccagaaaaccaaacactgcatgttctcactcataagtgggagttgaacaatgagaacacatggacacagggaagggaacatcacacagtggggactgttgcagggtgtgggggcaaggggagggaaagcattaggacaaatatctaatgcatgtggggcttaaaacctagatgacatgttcataggtgaagcaaaccactatggcacaagtatacctatgtaacaaacctgcacgttctgcatatgtatcccagaacttaaagtaaaatttaaaaaacaaataaataaaaataaaataaattaaaaaaaaatctttttaaaaagtaacacacctagtagctatttacttccataactattgtattttcttgccgtgccaaaatatctggcattgtaagaatgcacaattaaatatcattcatttactgacctagtatattgccagcaaagaacatgaagacatattctgctattgtttttctttctaccactgatggtggcaccaggcatttctcctatattccaaataaataatagaaaatacctttgcagccatatgagcgtttggaaattatcctagcaatctggcaagagcaaggaggttgacctggcctgcaatgatacgaacttaggggctccttgtggcctaaacttgtaccaggacaattctgagatcaacgttaccactgtcaatgagatagaagtcttctacacaaacaaatgtctgctgctcaaaggcctagtcagtgtacaccatctcccataagaaacttcccacaggaatctttagtaaacaactaaacagcactatccacaataagcagttgttatttattaatgacctattatttcaccaaacttatagtattaaaattgtaattagtagttgctatccattaagtacctatgagcctagcaccatacaatacagtatacattgtccttaatcttcatattacttaataatatgattaataatccccaaaatatgtaaaattaattgaattagcatacataggaaaaattcaaatgcattctaaaatttctttattaaaataagctagataactatgtggtcaaaatgctgtcatctattacctacgttgacttattgatgaatgtgtgtagatactttgtcactgggtcacttatgtcttgctgcttatccatgtctgcagaattttgcagagttcttccaggaaccgccaggctttctcaggataagatatatcagatgcattcagtgtgatcagacacattggggtacatttcacccagaggtgtacctgctgtttgtaatgctgctcaggatttgtgcctacaaacatgggaattctgataaattctatcttacacaattcccataaaaatatatgttgtgggattatggttacacttatacttttcaggtatattcctaataggagagacccatcattttgactaggcatctacaaaaacttaactctacccctgtcccttacaatttttcatgtttaatgtttagaagagttttcaacagaccatcttctagctccagatatttcaccttttctctgccactacccaagtatttttctatttctttaattttttaaattaaactttttttaagtaaatcatagatccacatgcaattgtaagaaataatatagagagacccatttcttccatatggcaacgtctggcaaaactattctataacatcgcaaccaggatattgatgttgatacagtcaagattcaaagtaccaccatcaccacaaagaccccttatggtgtccttcttccctcctgccagacccacttccctcctgcccccacctcctccttaaccctggcaaccaccaacatgttctctatttctatgtttttattttttcaaagattttatataaatgaaatcatacaatgtgcaacttttggtgactgcctattttcagtcacctgaattttctggagcttcatccaggctgctgtgtatatgaataatttgttcctttttattactgagtagtattccatggtatgaaaataccgcccaactatttttattgccaaactctgtagttcacattcatatcacaacatgacctccaccccagcaccttcatgacatgatgccaagtaagtcaacttagtgggcaaaaggaatgttccttacaggtattcaaattcagtttagcaatgcccgaattatatttggaagtttttaaacattccaaacttcatctccaactcaactttctcttagtaaaatgcaaaagttaactaatttttaaaagaaagaaaagaaaaagaaaaaattatgttgccactccaatcctgcctgatatgaagggaagtatggcagaggggaatacagcgtggaaagagacagtggtctcacacaattatggttaaaatattttacacttataaattatgtagcagtctgtgctcagatgaatacatggctagggcctcttttaggaatcttgaaagaggtcagaggaagcatgggacctggagcatagggctctttagaataaacctgcttcaactttcaaattgcctatatgttaacaggatctctcttgttaactggagaagctgccatgcttatctcaccaggcacaaaaatgcttccagccaagtcttcacaattgccctgaacaggtaaaatgaaagatacccacacttgaggctgatgccccagaatacaaattattaatgggtacaagacctattaatgacttgagtctgtagagagcacccagaaaaagaaagagctcttgatgtctcacataaaaagacgttttaattattgaacatttagtggcaggggtgagggaaggggagtgtgggagggcccaggtggaaagcagaaattttcctctacgactctctagcaacagcaactgccaatgacaacagcagctatgtgttgaacatttgttctgtgctagtactgtcaattcatttaagtcataaaacaattctttgaggcaagtactttattatgtccatgtttaaaagtcagacttattaaggtataatttatttatcctttttactgcaagcctcgaaatcaggtagtgtaattttgctaggtttgtaattctttctcaaaattattggtcagtcttggcctttagcttttccatataaaatgttatatcatcttatgagttttactaaaaagccttctgaaattttgactattgtcgcattgaatctttgatgaatttgggaataagtgatatcctaaaaatattgaatcttcttaaccatgaatatagtatatgtctccatttatttgggtctttaatttgtctcagcaacattttgacatttttatcaaacaaatcttacagatacattgttagatgtatatctaaacctctcatgactttgataatatttaaatgatatctccaattttcaattgtttactgctaacaattgatttttatattgatttgtttactgtgaccttgctaacctcattttattagtcctagtagatatttttgtaaattccttgagattttctatagaaagaattatcctgtttgtgaatagagacacattcatttatttatttttgatctgtatgtcatttatttatttctcttgttataatttacttggtataacctccagtgcaatgttggaaagaagtagtgagagtaaacacccttaccttatgcctgaccttgggaggaaggtattcattctgtcttttactattaaatctaatattagctgtggactttttgtagatatcctacatcagattgagggagtttcctactattcctagtttgctgagagttttatagttgaaaactattttcaatagttgcataattcattgttaactagaatatggtctatgttggtgagtgtttcatgtgtacataagaattatgtgtttcctgcaactgttaggtggagtgctttctaaatgttaagtagattcatattatcaagtaggttagtgttattagaatctgttatccaggtcctctatattcttactaaaattttgtctactgattccatcagtcaattagatagcaaagttaaaatatccaaccataattgggatatatctatttctcttttatgttttatcagatttttgctttccatattttgaagcactgttatgaagtgcatacaaatttacaaattattattttttcttggtgaattcgcttctttatgttatatgtctctttacttctgaaattattgattagctattacaatatatttttcactctttttctttcaacccatctatgttgttatattttaaggttttgttttatagacagcatatgatgtatttctgctttttgattctatcttaatatctatggtttttaaccctttattatattgctatttgttttatttttcctttgtctaatctgttctttttagtttttctctgttttcttctgctgtattttattttatgactccatcttattcccactttggtttattaggtaaacatctttattttttcaatttttttaatgattactgtaccgtctaaattatatttttaaaatttatccagtctatcttcaaatgatatttctccactttagataccattagaaaccctgaaacagtatacttttatttcatccagtccattctttatgaagttgctgtaatgcatttcatatctatataagtgataaaccccatattgaatgttgatattttttcttaagtttttcatttttttattaaaacagttcaaaattaaatcaaattcttttgtatttatcttcatttttaccacttttagaactctgtatgtcttatgcagatcaaaagtttcacctagtattatactcttgcttgaagaacttactttgacaatgcttatagtacaggtctacaggcaatgagtcctctcagatttgttttgtttattttttgtctttatttttataaagatatttttactggatagcaaattctgaattggcaggtttttcccctccaagtactttaaagttgtaactccattgtattttaatttgcatgatttctgcaaaaatatttgctattgttcttagttttgttaccttatgtataatgtgttttgttgtttttccttttgactgccataacattttctctttgttttggtttgcagtagtgtaagtgtaatgtgactaggtatattctattttatctatctatctatctatctatctatctatctatcatcaactgatcaattgattgatctatacttatactgcttgggatcacctgggcttctggaattgaaaatttgttgactttcattattttagaaaattcttacctagtctcttcaaaatttattctgccaagtttctctctcttcttgtctaggactccaattacacacatattagactatttgacattgcttcatagcagctggatgcaccattatgttttcttctctttatgtttccattgatatatcttctagtcaactgagtctattctctgctctgtccagtttgctcatacacccactgaaggaattttttatttgtgacattttatttttttattttgaccctttgcacatgacacatatttcatatagttttcatctctgctgaaattactcatttgcttacatatgtataacatctatccacgaaatcctttaaaatattaaacatagtttatttaacgtttctatctgataatgatgtctggatcatctataaatctggttttgctggctactttataccttgacagtaggttgcttctccctcaatatctctttctctctctctctctctctccccacccctgaccaatgagtatgtgtgtatcttgtaatttttggtttattgctgaacattgtgtttaaaataatatagactgaggtaaacagtctttatcctggaaaacaggcatgccttttattttctcatgccattcatatgcatgtcatgttgggaaggtttagtcagtctaatcagtttttgagcttggtttgtgttttgttattgccatggtaaccttcattccagcaataacttcacattccactagcatttcactgtcgataccttgtgcttaattggattttgtcataggaggattttcccctgtgttcttgctctattctcaatttttaacagtccttgtatgcttatgccatttaggagtatctctttatactattgttctgtcttaattattattttgcacattgttcaaggtgtgatgggtaaagtgggtagttttctattatcttgacccagcctcacacttacgtaagtcctgggtgtctagaccttgagaatggagctctctcagtgttcctgcccatcctcatggtagccaaatgtttcccttatttctgtaggaaggtgggggagctgggtgggagagaatactgttatttccccctgtgcattgtatcatctcaaaatcctgggtcctagcagtgttttttcctctctctcaaggaatatagattttgttttcattcctcttttggttccaatttacccctgcctatttctattggcaggggttttcttagcacttctgcagtagtacactgctattgcttattactcagtacaaaccttctggttggaacaggcagcttttgcttctattccttcctcctttccttttcctgggactggaagtagttgagtttttaactcctcctccagaagcaaactactttgcttttaccttctcccacaggcagtagttctttgccagggtgctaggagaagaaggagttacccaccccttttctgggatcagaaaaagggagacaaccagtattcatttgagagaaatatgaagatgcaccattgagggtgttcacttagttttcctccccttccctgaatactttctgtgggcacaagtagggcctgtaaatttaaaaaatacttagaaagtacagacttcacacatatctgaagtcctggggattctactctatcatattaactttacacttggccttttaaaacgtgttaaaaattttggctattttctccttactggctgtaattgacagtcacctctttctttcataatcttccaaaggtgaaatggtttatttgactaatctctttttggagggagtttctcagcctttgaaaataagattctgtgattagaagccttgtctctttattttttatttttatttttttttgagacggagtctcactctgtcacccagtctggaatgcagtggcacgatctcggctcactgcaagctccgccttccaggttcatgccattctcctgcctcagcctcccaagtagctgggactacaggtgcccgccaccacgcccagctacttttttgtatttttagtagaggcagggtttcaccgtgttagccaggatggtcccgatctcctgacctcgtgatctgcctgccttggcctctcaaagcgctgggaatacaggcgtgagccactgcgcccagccgtctctttaaaagagtaatgttttcacagattttgttgttatttttgttggtagagtaaaatgacattctcttgcagctttctacatttttagcgaaaagggagacaaccagtatcattttatatgagaaatatgagacttggagaggccaagtaacttgccgtgtatcgtaatctattaaatgttaaggccaacatttaagctcagatttttctgaaataaaagcctattgtcttaaacatcacactgcaatatatcttgtgtaatcttctcatcaaaagtacgtatttgaggtgtctaattaattctagtcagacccaactgttttcctttttattccaaatgagcactggaagcaatgttaaaactattcaacgagtcaatacattttctatcctaagtgcatctagagtacaagattttttttcttcttcaggtgagtatgcctagaaaatctaagcccttctctgatacctcagccattttggaaagtaaatgctcagcacttttgccattattaaataggcttgggtaactctaaaaatttctactagcgctgccttgtaaaaatgcacaggcaagcccaatgaggacatcatgtgatcacaggagcttgagcttaaaaagagaggacagcttcagggaagaagaattctgcatcaaattggggaaggcaatggagaggcaactcggaacagatggcacaacagaaagtagcttagtaggaactgatattgttaccagagaaagtatcaaaatcaaaggcagaggcaaagatagaagctagagcacagagaatggtcaagaaaggaggacagaattaggcttttgaaagaggtggaaaagtggtttggaagagatctacaaatgtaaaatatatccttctagtcacctgcagaagccatcctggtagttaggaacctgtgagagtctgatatgcagccagatggccctcacaccttggccagacatgtgtttatacagtaaattctatctcataaaccactttctcatgttatcttatttgaaattcatggcaatcctatgtagcagggacagaagatattgttagttccatttaccagatgaaaaccctgaaacagaatgttcataattcatcagattttccaaccatacctgcactcatagatcatgacataaacaacaatgctattttttcatcagtctgatcatgcatatttatgtgtgtatatttacttccaaggtgtctacagagttgcacacactctctgaatgttgctaagatatataaatgtggttacttttaaaaatcacaagaaatccattaatgattcattccatttaacaaattacaacatgataaaagggaagaaatttaaaaggaagaattctctccaaagttcaagcaacaaattttcatgtgatgttgggaaaagcaaaatgttttacagcttttagaggcgtaaatcaaaaccttcccactaacacttacaaccattttgaggttttattaaagaaaaaaattatctgaaaattcattacttggatgataaataggactagaaagaaagaggaaaggcctgcatgtggtaagtggaaggcattgatgaatatttggaacattcttttcttaagcccctctataaactgttttcctacatcatctttaaactgcacagatgggttcatgaatctggctccctcactatagcaggacattcttacaggcagggtctggacggattcactttttatatcctaagtgcccagcagagttcctaaatgcagtaaatgttcactaatatttggtggataaaaaatggtgccatcacaaaacacacatatacacacaagtacatatactcacataatagtagcacccataccattccataaatgtatacacttttatatatacctaatccatatgtatgtatatgcacacatattttcatctatataatgggctatatatcattataaataatacagaatcatgtaggtgttgttgctatgtgagtatgtgtatactcatataaaagtatgtttcatgcacttgtgtgtatatgtatacatatatgtatatagtcattttatctttgaatttttcacattatattttaatctcaaataagctttagtgaaagtgagttataacaatgagaataactgattttagtcttgactaatgagaatctcaattaaaaatgtaagtctgaagcatagcatgtcaaatatacatatgtttatataatataaattattttggaggtccccgatacttttcattacctgatcacaattacaggtaattgaaagttattagaaactaagcataaagctgtgcactcccgacaccacaagacctccaacccactagtcagctaaaaccactttctgatatactctgcacaatgaccctggtggctgtcagctctttcctgctttcctgcttccctggaacctgacagggccccagtgatgatttacctatgtcatgttatgtagtccacagcttgactgaggtcttgttctgattcacagcggagtgttgaacaaagtctgtctggaataaactgaatgcattcaggaaaatttccttctcgttcattcatttatttcctcattctcaaacattgagcatctgcaatgttacagatactgcattaaacactcgggtcacaaaagtgaatgaggcacagtccctgtctaactgctgctgaggtttccacagtgacattttcttaaaccccaacttatacagggtgttttcagagtgggattgtacatgttccaaacccaagtgattttgtttaataattttgaccatcaaaaatccagtttgaaaaatgaaccagaatacaaatatacaacatttaatgacagagaaaaaataaaggcatacagttttttaaagaaatatttcatcctttgaagaatactgagaaatctgagttcaaaggtgatgtgagcatgcttcaatcatgactatacacaacagaatctgtactcagctcagtattggctagagaagttctctttccctcatttaagccaagaccagaactccaaggctgaggcttgacataggtgtactgtaaatgaagtgttaatgagatggaaattctccaagttgcttttgagtctcactctatatcagtgtagacctgcctaaaatatgtaagagctgagaatccttttgaaatgattccaaactcttgagtctgaaaaccgagctgggaattcctttgtaacagttttgtgggttattttggcactttggtttataatcctagctggaccccatctgaagttctaaagcccataaaataagaatgaatggacaatgtaaataagccaaatttgagaaacttcagaccctgcttggctgaatgtttctgttaatctaccttgtctgtgctggtagaactgccattttgctataactcctttgtaaataagaaacttttcttctcatcaggcaggggatctttctcttcaaaggctgtgatgtattatactatattgaaattaaattgtttggatatgttttgctgaatactgataaaactatgatataaagcgtattatccttaatcaaaggttacttttatttgcagattttaaaggcaacaaaaatttttatttgacaggttctaatagttctagtttggcatacctgcacatttttattgtatcctgggaacaggcataaatcaactgatttcccacagacaaataaaagtggtggagtaatatagttcctggaatttaacacttcatggtcaggaggtcacatatgctaagttgcttatttacacgcctcttaaagtttaagtctgtgggcaagagacatgaagcaatgtgacttactatatcaatgaagaatgtattgttctttttcttcgggtagataaaattaacagtgttggaacagcagatcacacaagaatgtcatcagaaacatcagccattttttcaaatgtgcttgcttgatgattctctttgttattacaatcatcagttttaaacaatgagatttattaaacatttttttaagtggggaagagagagttagtgtgtaccaatcattgacatattagctggcatctcgaagcctaaacttgcagttaggccaatgtagccagaatggaggtgatgcagcaacccaggtgcctcctccggccctcacttttgctgccaaaactgatcttacagcccacatgttacagatggtgactgtaaactggagagatagccatttgacccacatttaactatgatacaagataagcgatagttattttcacagctttccatataaaggattttgatgagaacaaagttatatacaaacaaagttcatttacgcaacacaattgtattgagatcccagtatgtaactagtactaaacacttcttatacattattcccttttcacatgctcacccatttaaaatttcacagcattcttcagatcagtatattaaggcttagaaaagttttgacttgctaaagacacatagttagaaatcaaatgagtcaagatttgaatccatatctccctgctcagcatctacacttttcttcgctggagagtacattggaagcctaagctgatcacattccattaaacctcaagtcattttgagcccaaggcttcagtttcttcctttagaaatatatctcccttcaaatatacctggaatttacaggtgaaacactggcaaattaataaaggaaattacatcagtgccctaagaaaggcaggccaagagtgctggtaggaaccatagaagcaagaaaacccctgcagctttatcagagtccacatgcagttacttattgcagcatttaaagccttaaacccttgtcccttacctggtggcctcactggatccagcaacaaggaaggaggctgggcatggtggctcacgcctacaatcccagcactttgggaggccgaggtaggcggatcatctgaggtcaggagttcaagaccagcctggccaacatggtgaaactccatctctactaaaaatacaaaaattagctgggcatggtggcacatggctgtaattccagctacttgggaggctgaggcaggagaatcacttgaacccgggtggcacaggttgcagtgagctgcgatcacaccatggcactccagactgggcaataaaatgagattccatctcaaaaaaacagcaacaaaaaaaagccagcatggtacgcctgtaatcccagcactttgggaggcctaggcaggcggatcacctgaggtcagcagttcgagaccagcctggccaacatggcgaaaccctgtctctactaatgatacaaaaatcagccgagcatggtggtggcacgtgcccgtcatcccagctactgggttgggaggctgaggtaggagaatcgcttgaacccaggaggcagaggttgcagtgagccgagatcacgccaaggaaggaggtagaaggaagggttttcttccttccatattaaggaggccaactgcattgccaggactctcccggaggcaaactgaaaaatgaagctctttctgtttttctatgcaaatcgcaatgctgaactttctgagacctggcataatgcagtcacatgtcttgtttttgcattcagaatattgtcttttcatagtctttcagaatatgttaaggaggtttcactatatatcacaaatcatggtttaaatttcaaagcattagataaaaatgaccttacactgcatttgtagatgtcactctcaagccatcccaatgtagtttccatgggaactaatgtacatcaaagaagaaagagagagaaagagagactgtaagatcaaatttttagttcctgcctcctctttttctgggaaaaccaaaatgagccccatgttaaatgctgttgaaattagatactgaatcttatcttctatgtgaatgcagctttttgtttttttcctcctaagaaggagtactacctatatggtcatgcacaatttttccatagagtccatccatataatttataagttgtatttacagcctcagaaggcacatgtgcttatttaggaggagagtcaacatcatccattattactttgttttcaagttgctttcagaattattattattacacagatttacaacttgttgagaatccactctatggcaaccatgagtgaaagtggttcgtgaatgaaagtttatagtcacgtaagaacacattcctagattgtcctctgttggtgtagtgtctttcatagtcatatgccagacagtgtaacatgagtagctgtcattagcttcccatccaaaaagaacagttaccaaacagtattgttaaaaagagcatgttacagctattattctttttttcttttttttgagacagagtcttgctctgtcgcccaggctacagtgcagtggtgccacctcggctcactgcaagctccgcctcccgggttcaagcgattctcctgcctcagcctcctgagtagctgggactacagtcacgtgccaccacgcctggctaatgttttgtatttttagtagaaatggggtttcacagaattagtcaggatgctctcaatctcctgaccttatgatccacccacctcagccttccaaagtgctgggattacaggagtgagccaccgcgcccagcacagctattattcttaaatccaatgccacatatcaaggccaactttatctacctctgtctcataggactcacctgggttataaaataaattcaatactttaatcggggggtggttggagagagacaatgatatattatattctcaattataattgagaatggtgatataaaatgtatttgtagcctgtagataattaactagaaaaacaggtgatcatgtggtttaaaataacaattaatttaagaacttaaaataaatgtttttaaaaagatatataatagtattatatgtcttaataattatatttattaaatataataaatattactattatactatatttacaatagtatatactattatatttatatttataaatatgttatataatagttatatttatattatatattatattacataataatatataaatataaatataataactatattataaatataatagttataaagacaatatgacaaataaatattaaccatttaatttatatcagtcactaccctaaggattgttcttttatctaatacattttattctaataactctgttaattaggaattcatgttcccatctaacagattaagacattgaaggacaagaaggtcaaataaagggctgaaaaaaatctcgtaacttctaagtgaaccaggcagtttccaaaacctgcctcttagctattatgctataaatatttgagaaaagtatttacattgacaaataactatgaagtttttagaacttatgaagatcatggtgaagaaaaaactatttgtaacattaattatcaaattgtttattcctttctgaaatcatttattcaatatcatttatttgcagataataggtaccaggcattgagaaattcagaatgaataagaaaatggaataaacaaagggttataaaaaaatctaggatgggttattcattttaaaagagaatggagcttaggtaaaaaaaagcaaaaatatacacaaggccttgaacattctaacataatgagcaagtcataccctgccagatccatgagagtggatgacaggatgtgctggaaaggaacatgggaagtacctaaaatgaaaaggacctgaaatgtaattctaaagatttcgtctaaaagaaatggcaagttggcagataatttttaaattcaagtgtaaataatctgataagtattttagaaagctgactggatggtataaagagggtggattagagaaggaaaatatgggtggcagggagatctatgagggttttgtgatgggttgaatggtgtcctcccaggagatatgttgaagccctatttttggtacctgtgaatatgacttcatttggaaataggatctttgcagatgaaatctagttaagatgggttcattaaggtgggccctaattcaatatgactgttttccttataaaaaaaggaaaagacggagaaacagggagaagaatgccacataacaatgaaggtagagaatggggttacacagctacagaccagagaacatgaaggactgtcaccaacaccactgctaagagaagggcacagaacagattctcccgcagagcctttagaggaagcaagaccctgtcaacagcttttctgagttctagccttcagaactgtgagagaataaatttcagcttatggtactttttatatgacagcccaaggaaactaacacaagtattggtggaacacttcttcaacaaatagcacttgaattaaggcagcggcactaaaaatggagaggaggaggtatgtggtagaccagggatatatttgctaaaggacaaacgaagtaatgagacttagaaacagaatgatggagccacaaagaatgcctgaaatggtaataggatacatgcttgaatgttgatgggccccatttccacaagcctccaaatctgcttctagatcccattcgagcaagggaggatttgttaagaagaaaggccttttgagagcaccagtccctccaccagccagtctagtcctaagagctctgaaggccaaccttggaagtggtttaggagggaaaatgtaggacccaggatttcagttgccaagccggagagcaggggacccaggaaagaatattggcattcacttgatttttccatcttctgatataaccttcaaatgttaatagtgtgtcgaagaatttattggaagtgagaaacaagaaaacagtgagtctaacctagtcattctagaattgggaggtaatagaaaagagagaaatgggaaagttgctcaaatgcaagtccagtgaatcagagagaaaaggctcaaagcagcagaacaaagcttcaataaagagatattgtgacttggagagatggccttttgtcctttgttctattaccggtcagagaatggggagcacacccaagcctgagacaacagctctgctaagtgcccttgagagggcacggtggggtcagcaccaaagccagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaattaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccctcagactgtgtgttctgtgacatcaaagactggcaacattctaaaggtaaatgtaactatgcatccctttgggattttcagatatcttgtacaatctattttattcctctaaacatggagactataaagctgtgtggaaatcaatagtttaattcattcattcaacaaacaggtggtgagtgctcatcataacaaccacatctaatagctaacatgttgaatgattatcacacatcaactactatgcgaagtgcttttcatggtttatgtcatttaagtatcacaaataatactatgagataggtgctcttgttatgtccacttgacagatgaagaaactgaggcccaagtcccagtcctaagatgaggcagagctatgttagaattcaggtaatattactcaggaggccatgtattaaacctctttataacatatccctgtatcatatctgcattaggcatagaagactcaagggttatagggtttcagagaagggaagggctgaagggagttaattaggacaggctttaggcaaaaggtgatacatgatgttagctttgaagaagaggcagatttgagtcagcagagcgtgaaatcaaaggctcccaggtaaggaatgggaaagcacgtgagtgtagtccaaagtcaacataagacaaaaggcattgtagataatgaggggacaatttcgaccagaatggtgaccctatgagcagtaaaataagtccgagaagattgagttagccattggagagaagtgtctgacatgttggtgttggaaaatagaaaatcttggtggttttcttagtctaagcagtgttgaaggtaacagcagtggtacacaggatgaattacactaatagaaagcctggcacccaaggatttcagctagggtttgtagaaagatagaattatatgagatgtgttctaaagcaaaagtgataggacttgttctctgtgacatattgaaataaagtatatgaactgattataccaacaataactaactttattgagcatatactgtgtcctatagtggtttacatgtaatcatagattaattctcataatagcaccacgatttagaattaaaggaaggcccgttctaatcctaggatttctttcgttatctattgaagacaatgaaaacagtaattctttaaataatgttgtgttatgggggtattatgataccattgacaggagtgaaatagtttggaagtttaggagcagaaaaggacaattttgactgaaggcaagtaaaccaatcaggggcagtgtaactcattaggtcgtcataataataactattgttattattatttattttgattcgactatgaatcaagatgtcctgcagataccaaaatcagtggctgctcaagtccctgatataaagtagcctgccttgactacccttctttttataattataattattattacagctaattactgcatgcttattatgtaccaatgttctaaacatttcacatgccatagctcagttaagatagtaataattatagtgttcactattacaataataagagtttatatttacagtgctgatagtgttccaggcactgatatgtttttaaatagattaactcatttaatcatcacaaaacccacatgaagtagatactaatattctaccttcactttacagatgaggacactctggtccagagaatttaagtaacttaaccaagatcacaaaactaatgattggcagtgtcaggattgagcccagattctctggctgtagattctattctcttaacaactgctctacaaaatcatgagctttggggtcaggcaggtctgggttgcaatcccaaccttgttaacttactactagtgagaacttcggtatgctccttttttgtgtctaagtctcagttttcccataagcaaatttcaagataagataacaatagtacttttcatgcaataattcctatgagattaagctctcctacccttctctgtgcttattacattgcttcaaaacaggaagtcttcggtgtgtgttttactaatgaatgaataaatgaataaagcacttatcatccatgctgcacaattaacattttgttgtatgctactttatattatttaacttttctgtgcatgtacttttcttgtcaatccagctagattatatgcaccctaggactaaaccacatgctttttactttaatatgtacccagttctctgaacagtgatgtgcacatagaaagcttctcaataacgatgactcccatgaatgaagcatttactatggcctagacattgtgttaagtatttagtcttcatagcgaccctagatagtaagtactaatgttaattccaatttacagaataggaaactatgccttagtgagctaaagtgattttccagtggccacaccattagtccatacagagtcagattagattgagctctacttatctacagaagtcctgggcttgatcaccatgctgtactagcttggtgttaaagccctgattgatgggtaatttgacaagaagtcagagcccattatcacctgcctttggaagggaatttcctgcatctgaagttcttgtctatttggcccacttggctcaaccacctagttcacggcttttctgtagatttctcctcttagcactccctcaacaggcacaaaccacatatccaagtcagggatgccataaacagtggctgctgctgtggctggcccacagagcatggaagcaggaatactcatgagccccctctgtcatctcagtatattatggcttcagcattctctttgcttaacaacctctggctgatccactgtgaaaattgtgtgcaatagtcttcaaaatttctaatttcatacctgtggtgaagtagccttgcggctggtcaaagagaacacctttaaagctgacagtggaaaaagccttggctcctaaccttctgcaaaactgtttttactacttcatgcaagctgttattggtgtctttatttaggctgtatttcttcatttcagcgtctatgtttagcagttatataaaggagcgaaatgggtttaatggcctcaagtggcaaagcagtgacatgtggtccttcttggagcaacaaaaggtcaaaagactgtggaggagacttcttgtttcctggtgactaggagtcaaatttcttttatctgtctgagtcaaggggaaatgatgttcctttgaaagtctcatcttgtaggtagagtgtaacagagtaggaaggtagggaaggttccttaaagggccatgcagataatctcatctgttgatttgtcctattgtgggtgatacagactcacattccctttctggagaagggagggttttaattaaaactaaatagatatccactgggtctgggtatgtacataatctagaaactgtgggcttctcaaggcctctgcattcagcatctcaagaagtcctatgggtaccaattgatccatcctggaatcactctcctctgcttgcatgggacttgcctttctgccctccttccttagcactcccaccaggctaggtatgagccccgagtaaggagccctggtctgattccagcttctttctcttattgactctgtgatttcaataagatatttgactttacaagttctgcgtcttcatctgaagacggagactataatgaaaatacaaaccttatggatttattgtgcagagtagaaggacaaagtatacaaaatgctttggataattgttatctaacatcaaaatttaggttcacatacctgatgcacagtaagccaaacactgacacatcagcataaatgtttattcaatttggccaaagtgagagggcaggaaagacagtctctaaagtccaaccttcctttacacataactgggggcttctatgagtcaggtaggtatacaggaaatgggataccccaaagaccaaagctgtttatgtctcttggcctgatcagacttctggatgccatcaaggtttgtgtgacctaaggttcatttttcttctccaaaaaaaatacagtttatcaatcttgcaggccaggggtgtaaggatatgaagttactagtgactaccttctaccaaaatgactatgtgcaagcaagcatgcatggaggcagaaaaaggcaaggaaaagagaaaactaagtaaaacaaacatcttatgattcttataataaagactcagttacacaataacgttgtgcacactaaaatcccaatgaatgggtgctgttagtataggcagctggcatatttttccctagaccaatcagtcttgtatttctgtttcaaggcagcctgcacagattctccaaagcaattctcagcttattcatagtagaatcaaaataatcaggtgaaagaaaaatttattcataaattcttaatcaaagcttccgctgtacccaccctgaagcagtatgagcactaaaaccatcctatttctttttattatactttaatttctagggtacatgtgcacaacatgcaggtttgttacatatgtatacatgtgccatgttggtgtgctgcacccattaactcgtcatttacattaggtatatctcctaatgctatccctcccccttcccccctcctcatgacaggccccgatgtgtgatgttccctttcctgtgtccaagtgttctcgttgtttaattctcacctataagtgagaacatgcggtgtttggttttttgtccctgcgatagtttgctgagaatgatggtaaaaccagcttatttttaccatctattaaatgggacaaaaacttcaatacttctacagttgttgtatacaattaaataatcttctaaatccgattgtccctccttctcttcttctcctttgataaacaacacacctctctgcatagagcaacagaacttccttttgattctggcccacaacttcctatgtacacctcgtttgtaaagaagctcatctaaagtcaaccagcaaacgatgggccctccaactctgatagcctgtcaccagccctaagctgccaggcttcctttgagtgtctgtcattggtgagatatagggacgtgtgaccattttgccatggctctatgttgctgaaccaggtgggggtgtgagtggcagtggggcaagtggatccttttgatcattagttatttttgagtattgactttaatttgtaaaatttcccatcttaatctctgccctagtctctaagcagatcccagggcattgaggagagttcaggtatgccagcatgttttggtgtttttccaatgccaaaataatattttgcccactgaattcacaagtgttttagatggtcatccagtttttgtattgacccctcctaaagaggtaacagttatcccttggtatcaatcaaggcatggttccaggacctcccttggataccaaaatccatggttgctcaagtccccaacataaaaaaggtgtagtatttgcatataacctacacacctgtgtgtatatttgcatataacctgtgtgtaggttctcccctttcctttaaatcatctctagattacttttaatcctaatacaatgtaatttccatgtaaatatctgttacactgtattgtttatggaataatgataagaaacaagaagtctatacatgttcatatagatgcaaaatttttgaatattttcaagccatggttgtttgaacctgtcatgtggaaccaagggatacagagggctgactatattttaaaaaatgaaagaatattctttgaccacagcagggggctactggcatttggggatggggacaaaaatgttaaatactttgcaataagaacattaacacacagtgaaaattgtcatgtcaatgctcccttcgttgggaaagctgcaattagttataccttttctctctcctattagagaaatcaaccaagccaagcctgagtatctcagaatcagcatccttcagactcaaatttgagtcctgactactcaacatctataagcgttaagcacttactttgtcattcaatactcgtttaatctcctaaaagaacggcaagcttcttattattgcccctactagtggaaaaaataaagccagagaaagcaaagattctaacactgagcccagcacaagtctaccaccttatgctgtttctatgacgttaactttatagcatgatctggattgctaaaaatgttcaagtttgggccttataacaatagaaagaggactatataaaactacagtaagactaaaagtagctaaaacatattacaaaaataaaaaactggagtacctcgattatatacaaaagagcctttgaaaaatgtctaggtgaatttttgtctatgtacctatgttgacatcacaaaataacaactatcaattcaaaactcattccttctatatgtttttctcatatcgattttaatcaaaaggcttaacttgaatattaatctttcatgtcctccttatctatttgaccctctggaatactgctgagtaatgtggcattcacaagaatattactgtgtccacttaagtgatttaaaatgtattctcaatagccaaagtgtcctcctgactctttgaaattcagccatcctatgtttcagatggcctttcacttgggcttttaaaccactttacagacatctctttattctcctttattttataaattgggaaatagatcaaatagaagttaagtggcatatagaggtcaatggcagattactggaagacccagggaaaggtatcacccttgactcacctagagttatccctcagataatttaacatttcttcagaagactgaggtagcctctgaatgtaggaggcagactaaaagattattttttttcatgaggctgcctcaagcagattcacatttaattgtgattcaactggcatctcctttcttgctgccacaaaatatctatattgaaatcaggttgactgttcatcttttctttctgttacgtctgctagggatcaatagagataaaaatatttggagctttgtgttcaatctaagttcctgcatgcagttgcttgatagaatgattttgtaaggaagcaagtaaccaaagtatttttgcagtgtttttgataaaggactgctctttgctggtgtcctcctctccactactaattgacaaaacatcttgaggaaaacatccatatgtttaaattatccttaaaagctctattggcattaaaaaaagacctccgttttgataaagattccaataactatttggcttttgcaagtccagctttatgactagaaatttctagatcaagagtctgcaaacgatggtctagaaccaaatacaactgctgtctgtttttgtaagtaaggttttattcgaatacagtcttgcttgctcatttaaatattgtctaggctgctttcatgctacaatggcacagtggaatagctgggatagagactatatggcccgcaaagtctaaaatatttacaacttcactatttacataaaaatttgtcaacaactgttctacattaaacaatatatcagccctggcagatgtaactggttaccttgagtatctcatagcatgtatgcagtgtaattttcaagttcccaaacaaaactttccaaaagccatttcttaagaccacacactgtagagtcagatccaccaagttttgaattatctgaacagagctttgcaaatgtcaaaccagtatagtagatgatgacgattttgctgaaagatcactccactttcatcaggggaaacaagctattgggaatatattttaggacctcaattttccacacattgctctaattactagagtgctatagatgcatatctctgatttacagtccgccaagtcaagatttctgaatttcttggcataagtttggtagtacagtattactttgattatggcttcttatatctggcataaaaatattccctttgtgcatattctttttagatacagtacaaaaaaaagtatgactcttccttttttctctccctttactttaggaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataaggtaaggggaaaaatgtcaaaagtacatgaaaaaaatcatctctaagaaagagcaacaaatctgctagctcttaagaacttataattatcattgctggttaattggtattatagattacccagttctgacatgtaattttctaacacaaagaggtttctatcatgttacattgtgctttgcatttagggactttttattttacatttacacactaaagaacgaagggcagaagtcttgaaatatgcaaggatttagataatgaattgcatcctaaatttagaaaatatatcagacaatacagatgattcattgtagaatttgtaattctggaaaggcaagttttggggaccattgtttataaataagctaacttttattggctcagatctggataagtaccagaagcattaacgaacatttcttcagctgcacacggaccttcaaaaagttctaaaacagggtatgttattatgttttacaggaagatgtgtttaatatttgtaagtcaatatggataataacactgatttaaatggactgatagatgcatttgtcttttaatgtctattataataacaattgccaaaagcctatgaaaaattcaacatttacttgttgattagtctgtttttgattcatatatgcaattaattcttaagtgaagtttttcagagacactagcctctccttaaaaggcaaccatgttcacttgaaaatgtgaacagactatagatttgagattctggcttcacgctttgtcctgggaagcaaccttggatttggaatttaatggcttcctggctatctggactgtgaagaaatgcttctgaggggagacagatgtttgtctgaaactctattgtttaaagagctggactttgtctgtaacagcaggtatgaagatcagaaagaaagattgggagcccaaatgaaggcattagtactttgtaaacatagacctcatgccgcagtctgggtggattgatgataatgctacaaagaaaaatgcagcaaaggaaacttaggaatgaacctaaaagacacagtgtcttagtaaactaaaacgaaagtaaaaggagaccttcaaagcccactgcttgtaagatgagcttcttttttgaatattattccttaaaggacaccacacacacccaggtgaactcatggaatttgcattaaataattgataactttttgacatttatttgaagtttccttccaggaaaaaatggttcaagtagcactctggcattatttcataattaagcagccttttgcatgtaccatatgcaaccaccaaatctaaggtcctgtgttatgtagcctttccaacctttctaaatctcaagttttcagtaaatttaatgttttctttagagaaaaagacagtgagagacaggcagtgtccatttgaactagcaaatagtctgaccagatgacgagtctactagctcttctagtagctgctgcaaccagcaacttagtgggggcaacatcctcagccatgccacgtgggctttgcctgaagacaatagataacagccaagaggcagacaaagaaaatatgtgtaaaaacaatggtaaataaagtaaataaaattaacgaattagataaatgaataaaaataaagagcaaaagcaaatgtcaacatgcatcaattccccatccaaattacatacctcatgtaatttttgtaaacattttgtaagatttaccttcttgatttatcagcaatcattctggtttgcaataaaataatacctgtaagtggtttaattggaactgctgccactgcttgagatttatgaattggaatattacatgataatccacaggatcaccttgctttcctattgctgaagtttgcctcaattcttccttccattcattcatttactcaacaagcctccattgaaggtctgctataattcacataggggtccccctcccttaagaattgcaaattatacatgcaagagaaaatattgttttcactttttaaaaattatttcatttctatttttaaaaagagattgttttcagacagatgggctaccctgtacattttttactttgacaagtacattctgcaatgttttgtgggagaactgagtttatccttttgttaacttcaaaaggtcaggtatgtgcctcaatcctcatttgtttctattacaaacatcttaggaatccataaagttatataaactttcaaatactttgatatttgatgagcaaatctatgttcattctgttcataacctttatgacataccaaacaccaaccattttatctccaaattccacaaatgaaggggtcattatcacccaccaaaaagcggtttacaaagattttaacaatgtataaacaatcttgcttgaaactaatgaactcttacaatctttctgtctttttttaaaatttttgccattacttgttaaagaaagtgaccctattggatcgtgttttcacgtaataaattttctgcgaaatttactgtttagtccttggaggcatattactaaaaatcaaattggattttcttctgaaagaaggttacagagtgtgacttcatgagtggaagtatgttatggctaaagagcccatatttcatgctgtaatatagccaagttacattggtatatatattccttggccattgaaacaatgttaaacaatatttttcttttgtctaagatacagttagttaagctgtcattaaaaaataaacaaattgataatcagaaaaaaaaatcagagcaaagcaagctgtcaaaggttggctgtaaatccagcacaaggtaaaatgtggctattttaaaaagggcaacttcttcctaagataactgtttttttttttctctgcttaaaatagtcattgagggatattcaattgggaccagagaaaggggaagccagaatcattcatcaggcagatactttgtgtcagttataaacagtatatttcaaaattaagtatgagaaactccaggaggagattagacatgaggaaacaagctcagtaaagctaagaatcttgcctatagtcatctgtgcagtaagaatacactatgactattacagctaaaatatctttttaaatgccaggtattttctattctaattcttagaacaaattagagaactgagatttagagtggccccctcctctgcctaaaagcactccagatctggtcatttaatctctttggtatgccacttgtccccagggaaccaaactaacaagtttttcttctggtgtgctctttagcaaaaatgtagagtcatcagacattagtgtgtttgttgccagcttcgtgtgtgtgtgtgtgtgtgtgtgtgtgtgtgtgtccctctctcccctgcacttccaactgatttaactttccacttgtaggtgggtgtagctcagagaagatcaagaaatattgcactccctctactcaatattgtggaacaaattaaaacatgttcaatagttgtgtacctacaataggtaggagagctaggggctggggattcaaagatggcaaacacaatttatgctcctaagcaaatacacaagctcagcaatgggatagacaggatcaagtaagactgaatgtgctgtgctataatttgggcacagatcacatcctcttaatgcacaaagaaagaaagaactccaacaatgagaggagaatggatgggagggactgaggcaaacttcctgatgcctgtaacatttgaactgatctggaaggatgattataaaggattttaattgacaaaaacaatggtggaagagactgcatgagccagtgcaggaacattcttacattctaattatattcttatattctcatattctcacaggacattatctttaccaatgttaaatgattaaactaggtaataaacaaggcacacaatgatcaaaagaaaggggctctggggatgaacattctgcctttaatcactaatggtgtggcctaaactgtggggattaacaatgctctgtaatacccctaactatgcaatggggataagaagaacctctcctccacctgggcattctttattgttgtcttcataaagacttaggtgtatggaaaattgggcccagtgactgacatatgacaaagcacttgaaacatgattctatttttatcattattagttctaccaataataattatatacaattaatagaaataattcgcttccccaaaatcaagaagatagaattttaatataaaataaagttttaaactaaggatatttttcttcactagtagaatttttgactcagcatcagctggcaaaacgatttaggaaaattaaggaaatgttctagcatactccaaatcacatgatgtagttgcctacatattccaaaggctttcattctttgctcattggcatccatatttccacagaaaaggtttgcaagctcagggcatcatgctaatgtctaagacattccatcaccattaagggactttaaaattattcctagtgacaacaatatggttctttgtgttattaagtaaatcatggaataataagaacaggaagaacactatctcgttcactaaataaatgatcactatcattaaagagctattaaaccaaattctatcaggtatttttttaaagatgtgttcattctttctactcacttgctaaataagaaagaagaaaagctcaagagtctttaagcagaagctctgttctgcagctcacagaatggattaacaccagctggaaaaatctggggaaagtaggctaatccttgctaagttggtggccctatctagctgctgcagaagctgcagcatctgggactggcttttactcccaactggcttcacccttcccctataactcttatcctaatgttattcaaagagaattccatcatttgccctgatataagcatcaggcacacaaagtcaacccacagacactcctgcctatccctagaaattttgaaagctccagtatctgtttagcactagtaaatcatttcctgcttggtcaatccatattttactttgcgtatacagcctctacttttatccagttatatttaattaataaaaataattcctgtcttccaactataccaaggaaaatttcttcatcacaccattttagaacatttatttacaacatacggaaatacaattatatctttaagttaacaacttgtaactgagataagaaggcattgcttctctgagtttattttgttagagctgttcttttttttttttaaaggaagcttctgctcagaaaatgtgaaagaaataatctatctcaagaccttgctgttcttgactgttcaaaaattctttaaataaaatataatatggaagctgtgctctgcatgtcgagaccatttcactgttgagccttcacagccagaaaacaggctcaaaataattagacttgaacaaaatcacattatttactttttgctttaataaggaggtgattattagaagatgaaccatgactaccaagatagcaggtatagattctttttaacaaaattaatttagattatattcactatcttaagatacttatgcacataaatcatatctctctacgtatttttgcatgaaacatagagtatatgaaataaaatgaatgcaatgaatagaaatttaatcatatatttacctgaattattagattattcataaatagcttattagaggcagtaaaagtcgacagagaatgattgcaataggcagatgtgatgtaagtctgtgatattttagaagaaattttcctgtaaatcacacatgaaagatgcagccactcatgctggacaactgcctggtgttcccaagaaacatagggacaaccaaagggcacctcagtaagtttatactggaccatagataataaactcatcaacaaacaccagatttttgttctggagaaaaagatgaaagcttttgaacagtactagtcatcaccaaggaaactgtggtggagtaaaaaaattttaagaagatatcaacattgcagtaaatcaacctaacctggaaatgtgtttggtgacaaactgaattttcctaggtgtcggcaaactaactcttttaaggccccactaggggccttaagtgatctactccccaattcttccatagatgcacaaaaatactaactgatctattcattgtgtgtctttagaaatgcagacatttaatgggttacgaagcttaactgctagacacattcattagatgtgaacagttaatatgtagtcatttctgttggcttctaaaatatcctcatcactcttttgagacatagcagctcatcctaggccaatgatatcaaccatggctgtactgtgaactgtaatccagtatctttctctcaacacctcctctcttctcagctaagggtgttgtatattgaagatgctctgcttttccctctgactttcatcacttaaaactttgttgatttcacctgaggcaaattgacaaatatttttaatcatctttcacctttctttctcacttccaactcttctccaattgcctgactgaaatttctattccttttcctgtttttttcctacatatttcagaaatggccctgatttgagcagaaaatattaagaataatgctaataaaaacacattcatgttttcaaatgtaattaaattttaaaaaagttttatgctcaaacatttctagaaatatcctaaattacatttcagaagttttataaactatctcagctatttcttttcctcttgaagtgaatattttatcatcatacatattcaaaataaataaaatactatgttattcaattattatgttaccatactactgctgttttagttcattcagctataacaaaatatgacagactgggtggcttataaagaacagaaatttgttttacacagttctggaggctgggaaggtcaaggtcaaggcactggcagatttggtgtctggtgagggtccactttctggatcatatatagtgccttctccttgtgtcctcacatggtcaaaggggtgaggggtctctcttgagcaggttttataagagcactaatctcattcctgagggctctgaccccatgacctaattatctcccaaagtaaccaccttttaataccatccccttgagggttaggattttaacatatgaatttggtgaggacacaaacattcagaccatagcaattgcctttttctcataacatataaactctcaaactatattatatggtaattagactttagaaattagttttaaaaatctaactacaatgttcaaacaacgaattcactaggaaacttttagaaaataactgatttctaagttggagacatactatgtaactgtattaagtcacaaagctcaaattcagtttttctatttgacttcagtgtcaagattcttcacattttgctaggctacttactctccatgttcaagttatctctaatgactatatcgaaatagaacacagatgaaagcaaaaatagaaacacagatgaaagcaaaaatagaaattgaaccacaaacatgaaacaggtaacaaacagaaaatgtctctgagaaatgccttataattctaaaataaatttggaactagatttttgcagaatactgcttaagaaattaaattgtaaaacataagggaatcatttgaataagccattaataagattaatggaaaataatttattctcattttatctctagatgccatgtccagccaaataaatgagactgaacttcatggttgttgtttttacttcatcccggcaaaagaaatgaaattaaatataaaaagcagatgaccaaataaagtccaaatgaattaagtattgctcctagtataactcacagttaatataagttgactatcctctctgtagacaacacttttcatcaacatttttcaccatacagctagacctcaactaacagtcaagtgtcaaaaaaatgaatcactttagaaaccatcttaataatgagacaattgacttctggtacccaatttagaacatctacaaaaggagtggtgagcagatttccactctgatgcaaaatcttattcgttgggcattgatagctgagtgctgtgttaaggattctgaagtggtaaatcacaaagaatgctgtcaacacacttagtaaatagttaacacaggacttctctagtattaaaattcataatagtggccaggcgcagtggctcacacctgtaatcccagcactttgggaggccaaggtgggcagatcatgaggtcaggagatcgagaccatcctgactaacatggtaaaaccctgtctctactagtctctactaaaaatacaaaaaattagccaggcgtggtggcggacgcctgtaatcccagttactcaggaggctgaggcagaagaatggcatgaacctgggaggcagagcttgcagtgagccgagatcgccccactgcactccagcctgggtgacagagcgagactctgtctcaaaaaaaaaaaaaaaaaaatcataatagcaaataaatggcattcacgttataccatctccttttttgctcatggcaagtagtgtaatccctgccagaacatgggaggagacaatgtaacacatgtgccattcatttactcagaggtatacagtgtctttccttatgtgttaccaagtttaggctgtctgcacccctctgtgcactgttttttggagactgttccaatgtcactaggtaagatgctaccccctgtgatatagcaagacatattttgtgcctagagttacaaggaaaatcttttttttttctatagaaacaagactaggcatgacaagtatatgtagttttatttgttcaacaaatattgagataatacactatggttagtactgatgtatatactaaccacagtgtattatctcaaaattagatatgtatacaaagttgacccttgaacaatgcgaaggttagggaggctgacctacagtacagtcaaaatctgtgtataatttttgactcccccaaaacttaactgctaatagcctactgttccttggaagccttgctaataacataaacagtcaattaacacatattttgcatgttatatgtattatatactacactattacattaaagtaagctagaggaaaaaatattaaaatcacaagacaatatatactcactatttataaagtggaagtagagcatcataaaggtctttattcttatcaccctcacaccgagtaggctgaggaggtgggaggaagaggaggaattggtcttgctgtctcagggatggcagaggcagaaaaaaatctgcatagaagcggaccccctttgtccaagcccttgttgttaaagggtcacctgtacgtctaattttaccatagtctttttgatgatttcaggtttaatattgaaactttggctaaaattcacccatgggaaaaatagaaagtaccatggatttttatataaaaggagtcctggctatactatttacaaagcatgctaacatatcacttttcttctctgagtcttcacgttttctgaatatcaaaggtttcaaacttcagagagctgtatgggacaaatcaaataagacattaaaaacgcgttctggagagtaaaaatgctagcagatacaggtgtctcaacttacttgttaccttccatttctgtcccctactcacattgctttcttttctgtaattgtgtttaaagctgtccaaagagactctccaaatgctgggctctctgtctggaagtttcaaatgaggcttttggatgtgcatctttttctctgagggtaggattggggcaagaaagaaggtgatttaagtgtactggttgcctgggtgacaattaactgggtattgcttttagggagtcatacagaaaaatagaaaagaccagtaaaaaatgccatcctagtttgaatgctggatgtagtgaagggggttttgatgaagaaactgttgaggatcaactgagattagaaccacttggagaattaaaattttaataaggaggcattactttaaagtgaggggagggatttatcctaactgatgccttgttaaaaagaataacacagagtaaatagtcctaagaacaattgcaatcctttgtagtctgtaatttgtaattgctgcacataatttcagttaacaggccataagaggaacagtcacaaataccaagaaaggtacatacggagataattccaaccaaggtgagcacagcctacacataaacaggatgtaagtaccgcaagtcaccaaaactacactcaggagaaagtgctcgttattaacagacagtggattagtttcaatatctacaccaggggtcatcaaataggcccacagggtggtcctggatttgcaaacacagctttttgttgttgttgttgttgagatggagtttggctttggcttttgttgccctgttgtccaggctggagtgtaatggcccgatcttggctcaccacaacctctgcttcccaggttcaagcgattctcctgcctcagccacctgagtagctgggattacaggtgtgcaccaccctgccaggctaattttgtatttttagtagagacggggattctccctgttggtcaggctggtctcaaacacccaacctcaggcgatccacccacctcagccacccaaagtgctgggattacaggtgtgagccaccacacccggccgcaagtagagttttactggaacacggccatgtctcctcatttgctattgtccagttgctgcttccacactaccaggacagggctcagaagttgtgatagagattgtgtggctggaaaagcctaaaatattcaatgttctggccctttgaagaaagttaactgaatcaatctagactgttacacttacagtgaaaataattaaggattaggagttggaaggataactcaataattccattcatttgtgatgtgtattgtcattatttcattcaatcagcaaataactgtgataacatgtgcaaggaaacatgggagatgcaaaagtttagtaaagcaggtatcctgctatagtggagagagctcaggactatgcagacctgggcttgaaacccaacttgaatggattaagtggctttgaaggagttacttggactctccttaaacctcagttttcttgatcatttcacatcatcatttcataatcacgatcattttctatgggcatatctattcaaaatctctctatcagatcccccagtcaatatggagattgtggtaggcaccaagacaggaaggtgtgatttaggatcaactggatttataattttaaaagaatttatttatatgactgatgttttgtctggtggagcctgaagtaactatgcaaaatatctttgtattattactgcttgtttatgttacttatatagttatattatttcccaatcaatttcatcttttgtatttttctcttcaaaagttttgggctttacaatctcaaaacacattttcatcattcacatatttaaaaagtgacttttttcagagttttgttattgaagcagtgatacaaaactggttgactttttttctggggcagaggagagagtcaccaagtcaattgaattaatcatttacctcaccaccatatataccagacacagataagacaaactgacttttataaaatccctgcaaacccatcattacaaacattaactgggtcaatttcacctgaaggcaggattactctttcctataccaattttggatttcccagattaacccgttttttgttttgttttgttttttttaagaagtgtggcattagcaacatattcaaaagtctaaatgcttataagctgctttgaaaaacacattcaaaagtagaaacaaggttttagggaagcaaagataggaaacatgaatgagggtttagtaaacatagcataagacacttgttatcgaggcaaaaggattaattgagcagtaacatcatcagctatggttggacagaggagtggagataccagaagtgctatatccctgcacaaataaggaatctattttcagtttagactccaagcaggaagatactgctgctgcctcttgaagtacttcgttctttttctctgaagcttgaaaagtcactttacccaggagtggtgaatctggggtgctgtttctgtacctcttcacgcaacttgattggcatataaagatattgctataggtctctgggtacttcagtttctattgcctaaaatatgcttccaaaattagaaaatatgagcttaactctcgtaacagctgaagaagagcttacaaccttagaagacatagctctgtaattctgaaataactcaaaaactattttaaaatttcttcttctccagtcttccttcttccaacacataacattttcccaagggaaggcttgtaaaagcttctcaacagagaaaactcttaggaaagaaatggaaaattatagccatatcaatgaaacctaaaaatcaggcaaaatacataaaagggaaagagatgttattcctccagatttatacattcacatcttaactgatgaaagcttctctgatagaagtctgccctgaccccctgacatgacataacctccacagtcatttttttcacaatcatttcttatattctcctgctttattgtcttcatagcactctgtcactatctgaaatagttgttctgcttgcaccgttactgacaattcctcatcccccatttcaatgtagacactgaaatcagagcctcttctccatttagcttagtgtctagcacatactacacattgaataacatgtggtgaatgaatgaatgaatgagatgttccatggcagagttcatctcccacctctggttgatattcagtcccagcaaggatgtgcagctatcaagaagtaagcacacactccaatcttacatctttggggcattcttcttcggactgttgcaaaaaatttccttgtaatgtatacagagagcaactgaaaactctgaaactctaacgcattagacaaatatagatcttttaatgaatacttttatttaataaccagaatagcccttaggtattgtctaattcacagccctttatatagcaatggagaaattaaaattaaatggcttttttttccaaggtcacaagctagtcttagcttgagccagtatgaaatgccacgtctctgaactcctagcctggtgctcattttactggagccaagaagataccttcattgctgggcaaaggaatgaacaatgattgagtacctaacacgtttctaggcactttgttaactggttgtggtagacaatgtgtgttgctgacccaagcaccatttcttcttcctttcttccttacagaatcccaaatttttaaagtaagcatcccatcagtagctctagagtcagattctgtctagtctaagtcatttcatgcttagcaggtcccattacaacagccactggtccaggggtggccacgtaatttaatttggttcaatcgaattgaaggaaaagaaatgagccatgcctggaggacatgattctcttcccaccttcccctttcctctgctagttataaacagggcgatctacagcccaatggctgcctgtagccatcttgtggccataaagagattcatctttaggatgaaatcactgctgaagatagtaatgtctatatttatattaagggtcagtaaactctgcaaagaatcatatagtaaatattttagcattgccaatctgatggtccttggttcctgcagcaactattcgactcagacattatagtgcaaaagtcaccagaatgacatggctatggttcagtaatatcttgttttcaaaaaaaaaagtcatcgggctgtttaaatcattgaacctttttgacatcattgagccacatatttcatcattccttgagcttatcctgcacattaactcccaatatttgagatgatcaatttccttatgatttaaactggctttagtaagataatttttaaatgttattactaaaaccaaatcaatataattaattcagcatttatatacattattactcataatattcacaaaactcccataaagctgatattagtagactcattcttaagataagaaaatagaaccaaagtttcagagtctttgaaaatactggttcaaaaaccggcatttgaacctatatgtctaatcttctactctatgatgacccaactcccaactatctattcctcagcacttaaaagtggaagaacagtagctgcttcagtaaagttccaaacccaccaccagcttatcaaacagaaaatgatttcatgcagggaagtgtgcacttagaaagtcttttgaagggctggaggaatggatgtcagtggactgcccctgaatttttagtttctaggtcataccattatatgtgaaatccaaaagtcaggcagtggctactgctatcagttcctaccactgtagccaccatagcctcctcacaccaatggctccccagaatgtcatgttgaaccactataaacttcataactgtcaaattttacccgtagctacagctgcataaaaatggcctctgcctcacttctgatttccaaatctcttacaagtgcatgtaaatgactctagctgcaaaggagtttgggaagtatactttttaacctctccaataggaggatcaaatggagattggtaagacttctcttcagaagattgactaaggcttctccctagaatgtctggcatgtgtatctcccatacctgacaaagaatgagggcttcaagacagctaaaaaattttgaacaagctttaaaggactattttctcatccccagtcccatcagctgagccagaataatgacttcatagtaatttttccctgtacctttgagggaaagtaatgcattcattattggaataaaagtggttcatgtgtataaatcttgcccttggcaaaataaattatcaaagctcatgccaatgggagagatggcaggtccatgatgctaagagccaagttccataaagtgatagggaagcagctttcttttatccaaaagaatttatgttttatggctcagtgttggtgaggtattgatcttccaaatgagacactgtggccactgtaaataaattcaatagatgtgtagttggcctaagaatataacctcagttatttaaaacatgtggcacttgatgcagatcaccttccagtgtcctgtgtggaagaatggagcttccacccagtacaaagagtactctgggactccatgcctaagctccttaattagcatagtacatgtttgggggtaaataactccacctctctcaatcttaatttccacagccctgaaatttggacatgatagtatgggaggattcatgagaaaatgtgtgtggaatgatttgaacttcttgaagaatacatactcaggaatactgctatttgtgatgagatagtgtcagatgcataaatttgggttctttgaattactggcatacaggaaaatagcaaatctaggtcaacagagacctttttctcagactgcctttactatgaataaaacacaaaggaacttttctaactttctcagaaaagtgtcaacttctataattatttcaataaataatcttcctccaggaggatataattttaaggtgtgtgcagtgtccttttaaagacaggtttgtaggtctcactttcttttatttccaagttatcccctggcaacaagggctgtttatgtggagtattaaacaagcttcaggactgtgcacagaactcactcctattatatcttattttaatctgatattaccaaacttcccatgaactaaaaaaaaaaaaacccataaattttaagtccagtgagatttctgttttctctggaaattagagagctgaactgtgttttgtgtgagatcatccaacagtttttttaaaaaatcttacttcagaatcacattgaaatcattatgtcttctggaaaccagctgatagccaaaacatttatttaaattgtttataaaatgggtgggtggtatttcataatagttattggtttactatgcatgacctgttgatctacctgttgaaaccattattttaaaatatatttcccccaaaaatgctacttctgtatatttgtttttatcaaatataaatttacctagctcttttaagacacagatctcacccactgaattatgactaacatgaattttggaaattgtcctattttgatatgtcaggagagaacgttttactagcaggtttcattagccaaggtggaccagtgggtattttctgacattgcaaaagcagcttcaaagtgccactttcctttcctttccaggatgggtcaaataaaacaactctactccattctgtaagagattcaggcacagaaaggagaagatactgggctgctgacacattttctattcataaatgcttctgtttatagtagaaaatatgacattcaccatgagctgaccagccatcagttctgacatttatcagcgtcactttagaaacccatgtgggaaggcagaaaagcagaagggaacagaaactcacatgccacttgtagcagaatgcttgtgccatcctgactccccctctctgaaagcctgactgtgcaccatcctccttgataacaactaccaaccactgagcaagcctgcggtaggttatgtaggttctaggggaaggggatacaaagctatgttggacacttggaaatgcttagaatccagtcggggagccagcacaggaaacagaaacatctgaatgcatagccagctactggccctctacatgtatagccagctaataatgtgtgtgtgtgtgcatgcacacacacatgactagaagaggcattgtgcctggcagtgaaatgacagaggaaaggcatttattgtatgagggaaataaaagtagggaagtggtatcttaagagcaaaacatacagtctattccttccactccaaataattgaatgcttctgaatgtgcattccaaattttgagattaaatgaataaggccaacctgctgctgatggccacagtcagaaaggagggaagagaccacccaacccaggacaggaagtggagcagacttcatctggaacttgggaatgcctgcctccatgaaaaaaagtgtaagtgagatttccccctttttgatccatcttcaaccacttgataaattttcacaaaatcagtaatttcccaatgtggttgtgatggagcagggtagcttcctatttgcaagcattgggttaagcatctatgttttaaaagaattaaacatattaatataatactgtcccaatagtgcttacaaaacgtgtgtgggagacacactgctgagtttcaggaaataaacatcccttaacacaacacattgtaatcaaagaagcatattcacaaaacgttaaaactttttgccaacttcatgccagcaagcccagagggagagaacacgtatgctctttttcaatagagtatcacattatagacccattcaataaggtctgtatgagttcatttgtttccagataaagatttctgtgtgtggggagacttaacaacaaccacaaaaaaaggcttcgtggagaagggaacaaattagttggtgttttaaaagacagaagtatgtagacagtgaaagaggaatttgcaggaaatgtggtgggaagggtaccagtaaatcttaaactgagggaagagctcaggcgaaacctccagtgatcttcacaattctcaggagaatgcttatacatgatttgcacacaaaatattgaatttgaaaaaatcttatattgaattcccaagccacttgtagaatgcaatgtggcacactaatgtggtagaagggacataaaacaaacaaacaaactccctgcacaaatacccatgggaaaggaagaacagcctcacagaacttcaaaaagagaaaacaaagaaaaaaaatctcattttccaatgtatgcaaacatttattttctgagcaaagacaggattacaagtaggcagaatataagatttgaaaagcaaaaggaaaggttacatctccccaccacctaccacccacaaaccagttcatccacaggcaagctgatactgagactctacaactacatatttatacttttgacttaaatgtggccttctcttgaacagcaaataatcccaagatttacaaattaagccacatgaggcatttacacattaaagaaatgaatttttaagtctttcttaagacagagatttttgggtttggaagacagagaaagaatgagagtacttaggggaagatggcatgggttaggggtgacatttaggatgaagtgaagagacaagttatagtagcttaattcatagattaaaaggaagacctttataggaatctggttgtatagctaggagccaaacagccccttcctgatcaaaaatgttttcatctagtcttttacaatagaaatttgtttatcttgttttaaagtattctttatgtcatgcatgtaaataccaataaggtatttaaatattcccatattgacaagtatcgctttgcttctaatcttttttttttttttttttttttttgagatagggtctcactatattgcccaggctggtctcgaacttctgggctcaagctatcctcccactccacttcaccatcctgagtagctaggattataggcacaagccacctcacctggatttgcttccaatcattttctataagcaaaatgttacatgaaaatacttgtatttatatctttgtaattttgtgcaagaatttctaaaagaaaaaatcttagaaatcctagaaaaatcccaagtcaaaaggcacttgtatatataattttgaaaggtcttgtcatattgctctccatagaagatacaccaatgcatcttcccacctgcaatgtatagaacacctgtgtccccatattcttttttctttttttttttgagacgaagtcttgttcttgtcacccaggctagagtgcagtggcacgatcttggctcactacaacctccacctcccaggcagagaatcaagagaatcaagtgattgtcctgcctcagcctccccagtagctggattacaggcacctgccaccacgcccggccaattttcgtatttttagtagacacggggtttcaccatgttggtcaggctggtctcaaactcctgacctcaggtgatccgcctgcctcagctccaaaagtgctgggatttcaggcatgagccactgcacctgacctgtgtccccatattcttgccaacatagtgtattatcaaacttgttgatctttgccaatctgaaaagcaaaagtagtattcccttacagtttcaactgctttttacttgacttacagtttatctgggtagaaaatttagggatcacattctttacaggttgtggttattgcttcaaaagactctagcattttatattaatgtagagctaataaggatgacctgatttttcttcccctagaagggtctttaaccttttgcctgcttgaggagtcctttattatatttcaagtccagtagtgttaacagaatatgtcctttaaatatatagacttagatctccttttataaataagtcctcttgaattatattttcaaatacatttgaatcatccaccacttttctaaactctacaagctcatatttctttccgtagtcttctcatatctttcctgaactcttacatgaattttttgtgcttttattttatgaaagcagttgctttaagtcttattttaatttcattgatacatttaggaacaacttttattgttctgtgaaaaacgggtttgttttccagagattattctgtaactgccatttggtttttatgttctctttaaaaatgacaatacatactatgctagtttttgttgtttttaagaatatacctttttcatttgactaaaaatccttgaccagctctttccagaaaatgtggcaggggaacagagacatgttcaagtctaaaaagacagaattatatatgttatttcaattttacttcgccccagtctaccaaaatcaattctgcagagctgctcacaatgtgaaatttccttatgtcctctacctcactgatactctacctgcaaatgcagctcatctgtgaacatggcccataaagatttccctctctatttctcctcagaatcagactcagggaatttcccactaagagtccctagaccttggtcctgttgtaaagaaaaacgtgccgttttgcaataggttgtgccacttaagttagaaaggaatgctttgccaacattttctgagctctgaagttatgaccatttttttccagtgtctctctccactcacacctgtttcaccttgactgatttggggtgctcgcttcttattttgcaattcagagatttaagtagtctgctggtttcaaccaaaaatttaacttttttgctttttatttttctggttagtttttaataataattgaaagaaaaaaataagaaatggtcattttaatcagccaccataaaactaaattttttaatgtttctttaagggaatattttaactatattttgtttcttgtattgtaattggtctatttaggttatctacttttcttgagtcaatgttagtaatttacagttttctagaaactatgcatttcatctggattctagatttttttaaaatgtatatgctattttacatatatttcgttacatgtataatgattacatatatgataaaaatgatatatgttattctttttatttttaaaaagttctctttatttgtaattatatccccttatcttctttcttcaactaacttacaaagtagattggtacagattaccagatacttttcaatgttgtttaattcataattttttctttgcaaattctgatttacttgcattttacttattattttccttgatttagagtacaatactttatattaaactatgttgttttcaattaagcattttggggattgtgaaattaactctgaatattgcttttattgtatctcggagggattgatggttaatattctcactgtttgtttttaaaaagtttctaacaccaattttgattctctgtttattgtcactgttatgcattttttaatttctatggtaaatggatttaattggctattaattcattgttcttttctaaatttacgcatgtagtttaatgatatagtctgaattatatccatttggtattttgtttttaatttcttgagatgatgattaatgactaatgtctagtaaattatttcagatatttcattaatgttaaaaataatgtatattcttagcttaagtaacatatttctatgtttagtaaatatatgttgttcatcatgttttaaaaatttcctgtattcttagtttccaagaaaaaagcattaaagtgccatagaatattaaagagcaattaaaagaatgaagatctcttcatatgctggtaagaaaagtcttccatatgtttagtgttaaactaagtttggaacatctacaagtctttgcccaaatactctcagtgaagcttgcctggccatcttatttaaaattgcggcactcctcaccacacacacaaacttctcacccctcttcctctgctgtgcaatttcaccgcattgccatcttctaagatgttacatgatttgatatgtgatgcttattgctcatcatctgcttttctccactggaatggaaacttcacaagcccagtagtttttgcttcctttggtgaccaatgtgtcttggtgcctgtacatgtgggtgctcagtagttacaggttgaaaatattagtacgtgcattacggtaattcatgtaaaaacaaaaccacaagctactttggaaacaagtatatgcaaatgtatagaaaaagatctggcagtacactcaccaaattattaacagtgtttgatttgaaggtgtgactgaaaaatcaagacagctattaccttttatcagatatctttccattacctgctaaatttcatacttaaagagtattgtctttgtcattgcaatgttaaaatttttatttggaataataaaccattcagaaaacaattaaatattttgataacaaagagtaatagatgaggactatccttgacatacatgaaaatacactataagattccaatcattcaattagaatggtattgataagagaacagacctacaaatcatggaactaaacagatatctgatatagattacttagcatatgtaagaaagtaccacataacaaaagagacctttcaaatcagtgacaaatagaaggatataggaataactattagcttttggaaagacagggtaaaacaatgtaaattttcactttatatataaaaatatgagtagatttgtgaacatgaaacatagcactcagcacagaaaacatcataaataaaatttaaagtccaatattgtcttagaaaaaattttgaacaaacataaagacattaggttgagatccttattaaatcaaggtcactaatgaaaaacactaaaactctagtaaatagaccaagctcttaagtatgtagaactgattcaactataaaccaccagtttgtttctctgatttaatgggacaaaaggcacttgcagatggttactttatacagagtgactctatgaacaaagtctgtggaatccacaaacagcacacttgcagaattttgaaaaagctttgagattgtgggagtactgccctttacataaactgagacttcccacatttatttttattgtagtttaaacacaattcaaggatgctagttcaatgacaaatctgcacgaagtaaactgggacaagaggttattcaattgcccagaacaggaagaatttgtctctctatcatccctgtcaataataattagccctttctgaaaagggtgttgtagatacacagtcaaaatgatccttaaagggaggatataatttggcttacagaaatccattaccaacaaataactgcttgtggaggaaatatacaacaaagcaccacacttggaagtgataatcacagtaaatagcatccctagcctagattgggtcttatataagaaactatcatattgccaattaacaagtattttctcagtgtgatgacactttgaaatggctaaatacaaaattgggaggagaaaagaaattgcttagtctcctccctacccctcatcccctgcctccacagctccccaaactacacaagagaaaactcaataattctgtaagaatgattttcctggctcagttttataagagacttagaaataatacaacatcagtttataaaccagacagggcttggcctgctatgtcaacatagaaaatcaatccaggagtcccaaccctgctttgtggcctttagggctgcttcagaaatcaattcccaagaaggataaaaggtcactgccatggggctcaggaacacatgcctcaaattgccagctgcagagctcaattcccccagggacttggcaatttcggctctaaatgtggattcacaagggagagccatcctgaccaagcacatatgctcttttgaggtagtggccattttcatgccgacatttttgaggccctatcatgggtcaggactgagctgaggctttccatgcattgcctcactgaatctccacaataactcctgtatgagtccgttttcgcactgctgtaaagaactgcccaaaaccgggtaatttataaaggaaagaggtttaattgactcacagttttgcacagctggagaggcttcaggaaacttacaatcatggcggaaggcgaagaggaagcaaagactttcttcccatggtggaagaaaagagacagcgtgtatgtcagtgcaggaaaaactaccatttataaaactatcagatctcatgagaatttgctcactatcacaagaacacatggggaaaccatatctataacccaatcacttcccaccaggtctctctctaaacatctggggattacaattcaagaggagatgtgggtgttgacacaaaccctaaccatatcagctcttgagtagatgctatcattatcatcatcccccttcacagaagggcacagagggacttagagcatgtggctggccaaggtactaatctacccagtgaagtcagaccttttaacctttttctggtatgtttgtattcattcactggggctgccttaacaaagtaccaccgattgggtggcttattcaacagaaatttattttctcacatttttagaggctagaagtccaagatcaaggtggcgtcttctgagacttctctatctggcttgtttttttcctttgtcttcatatgatcttccctctgtacctgtctgcttcctaatctcttcttacaaggacaccagtcctattggattagggcccactttaatgacctcatttaaccttaattgcttccataaaggtcctacatccaaatgcagtcacgttctatagtattgagggttatcactttaacatatgagttggggggagcacaactcagtccatcacattctctattattgtaattgttcagatccatttatctcttataaaccaatgatcaaaacctgtacatccaactctctgcccatcccataagaaatacctggttgtggctggagaaagagctacaatatactggctggtctcacttggcatgttcttgacattcaggataggcggagtgacccagcaatcatatagacaccatccattccagtgacactcaaacttcagcgtgcatcagaatccctgcaaggcttgctaagacacagactgctgcgcctacctcagagttcctgattcatcaagctggaagtaaggcctgagatttttgcattactaacaagtcttcaggtgataccaatgctgctgatctggagactgcctttgagagccactattctatctctttcccaatcaactgtcctttctcacctcccttttaaatctccagcacctgctccctcatgttcattctcaatgcacaatctttttttctccttcactgacagaggtgaaacaattaaaagagaatttccccagtctctcactactgcacctgctcaccctcccacaagcacgtgtactcactgtgcttttcttgctgttttgaaaggtgaattgtctgtggtctttctagagccaatctcttcacatgtgcaccagattccaagccctgcggcccactcaagggcatccctgcatgtcttctcccatctcttaccttgtcaactctttccactttttgagtcatcctcctcagcacaaaagattgttactcatttatcttaaaaagcaaaaaaactaagccaacaaaaacaagaaaaaacagaaataaaaccttttactggaccctctctccctaccaggtatgactccatttctctttgcctttgcagaaaaacatttagaaagggggtctgtattaattctatccagttcctctcctctcattctctcacagacccactgaaatcaggtcttaactctcaacaaaattgctcttactgaggtctcagataaacttcaggttgctaaatctcatggctcacatttggtcctctcacattttacgccccttgacagagatgacaccactccttgatactttttttttttttttttttttttggcttgtaaggctttctaattcactggttgctagtctcagaactttgtgaatgatttatctttgcttatacctcttagtcctggactgacttgccccagattgtagtttctttttttatccactctccttcctttggggatctcatccagtctccctctgtatgccctttgttgccaaatttacatctccagccctggatgctcctttgcctcagactccaaaactatattcaaagtctctcatttagatcattcaaacttttcaagagtgactcctgatcttctcccaaatatctgagctgctcaaagctttccatctcagtagatgaaaaattcacccctctagtgcttaggtcaaaaatctttgagtcacccttgtttcctctctttattactccccccactgcacatccgattcaccaggaagtcttcctgtgtttaccctaaacataattcagagaccaattactcctcaccgcctccatggctatcactttcgtcagacttgctacattttagcaatcgtcttataactgttttcctattcccacccttgcctccttccattctattgcccacaaagaaacataagtgatccttttgaaacataagtcagatcacggcatttctttcccaaaaagaaatgcaagtgtctaaattcttcgcctacctcagggtaaaagtccaagttcttatatggcctttaaagacctctgtgtactctcctcctccctccattagttctctgatcttcccttcttcttttcttcctcatcctactctgctccagccacgcagtctttctggctatttcttgaacatagtaaacatgatccctcctctgagctttgagttgtttcctttgcctgggaaattccatctggagacttccgggcttgctcacctatataggcaagtctgtacatgagacctgctctgaccactcaatttaaaatggcagcaaaatccttcctggcaccccacctttaaaatggcaacaaaagccttcctggcacctttcctttctagctttggacctattacataatctatgtatcttttgtgttatcatctgccttccccgccagtatgtaaactccacaaaggttgagatttttgtttggttcactgatgtatcccaaggacacagttcagtatctaacttgcagtggaaactcaccaagtatttatcaaattatttgataaatgaatgtgatgataaatgaatgtgactgtaaaatgatactttatagtcactggagaaatcagtctctgacatccccaggaacaaaatcaacattctttggaatagtcattgataaagggttcataactttttgtgccatggacttctttggcagtctgtagaagcctatgaaccccttcacagattagtatttttaaatgtacaaaataaaatcaataaactacaaatgtagtaaattattttatcagaacatttttaaaattataaaacaaatttgtagctaatagtaatacacatacttcgttatccattaattgacaacatctggtagtggttctaataacgaccataattttgaagtactgatgtctagactgatatttcaagatgtctgtaataactctaacgtgatacgaatgtatctgtaatttccactgtgaataaagtcactggtactgccaatagcaccatggtttcttgcctatattcataaatgaaggaaatgttaaattttagctagttaaaaaaaaaaaatgaaaatgaggttgtattttctacagatacttaaatgaatgctttggaaacacttgtaaggagtagaaataaaagcagaaagactttcccctttcttactcccccagaaggtgctactgaattgttgcagataaggaaattgtaagataattgaaaaaatgataaaaatctggaagaattctgtgccaagactgtttttgctttcgcaagtgtctaaattcttgttctactttaatagaatcaaatctgcaaattatcagagtgatgatgtacatggttcatataaagcagacaatgtggaactccaagtatctgaacaatcagatcaaaatacccagactacatatcaagaaagcaggctgagtgtgatggttcatgcctgttatcccagcactttgggaggctgaggcaggaggattgcttaggaactcaagaccggcccaggcaacatagcaagacccttctctacaataagaaagaaaagaaaaaaaatagaaaagaaaagaaaaaaacagaaaaagaaagagctgggcatggtgtcacttgcctgtaatcctagctactagggaggctgaggcaggaggatcccttgaccgcaggagtttgaggttgttgtgagctatgattgtgccagtacgcttcaatccaggcaacagagcgagaccctatcttttaaaaaaataaaatagaaagcagtgcctccatgtgcttcaatgtgcatttatgtatttaagataaaataaactttttatgatgtatatttataatttcctatcatttttcactcacagttttgtggttttctctttcttttcttttctttccctttcttttccttccctttatttttcttcttccttttttttttattcaccaactacccaccttccctaattcgtaggttagaaggatttctctacagttctttctcttttttccaatctcttctggatgtttctttgtctcaaactacatagacattgtggaaatcagtatcttcatttcaagtctaggtgggtcaaatttgattctcttgtattttcactcttaaaatagcatcttgaactttcacctgtgatccatctataaggatcaaatgtaaggacttcaagagggcatctgcccaataatttctgtatacccagtacagcaaacagggtggtattgttgatgtgtactcagtgcatacaatagtatagtagtgttgtatatgctttgcagagagtagcattattgttgtatcagcacataggacaggacagttttattgcaacataaccaaaacataggttaaatgttaatgttgttgtacacccagtgcatagaacaacataaaattgttgttatatgttcaatgcaaaccacagagtagaatgctcaatttttgttgaatgacataaatgaattaaatggacacagcatcacctacatgcctcacctacaaaggcctaacttgtaatgggattactattgttgttttaataaattaagcaacgaatacagtttcaaaaagtacttagctttatttttcaacacagtaaatatgaatataacccatatcagtaaaagttgtttggggtcttcaatgatatcttaagactataaagaggtcctgacaccaaaagagggagaagcaccgcaatcttgcatgctcctggctcctgagaggttattgcagtctgccatactattgtatttccagtacttacatggtgttttggcaaaacctgagcatgtgttgtcaagtggctgatgaggatgtgattctgagaaaggcaccacgagataaaagatatgaatctcagctgggcgcggtggcccacacctataatcccaacacttcaggaggctgaggcgggcagatcatgaggtcaggagatcgagaccatcctggctaacacagtgaaaccccgtctctactaaaaatacaaaaaaaaaaatagctgggcatggtgacaggcacctgtactcccagctactggggaggctgaggcaggagaattgcttgaacccaggaggcagaggttgcagtgagccaagatcatgccactgcactccagactgggtgacagagtgagactccaactcaaaaaaaaaagaaagacacgaatctctttaacgtgagtaaggtttagatttttatcctcgtagaagaaacagcaacgcagagaatagacaaatctaccaaggtctcaattcctacaagttcccccagctgctgagtgtgaagccccacgaggttctttgaaaagtgttcctttgccagtctaaactgttctgggacttcattatagcaacgcctgctcaccacaggcaaggaaccagcaatctgatgaaggatttattgaaaatgtgggtaaatcagagtttttgttcccatgtgaatgattcccccggcaggcttgagctttagaagctctataaatacttactaagtaattaattgattgactaaagaaataaatgaaaaaaataacaataattataaatcgaggaaatgtaaaatatgtattattgtcacaatggatgaaaatatcccaaaagagatcatttggttgtgagttaggttttaaagtatacgcaatattagaaatgaataattgaagatagtttcaataattttaaaaactactgcccaatggtaaaagatataaaagattatgtaatttacaaggcagatgtcctatatctcttgaattattttagactgggacacaaaaagcccaggcagtcaagatgatattaaatgattcaaaaatagcattatttcaattaaacaaataaatgcccacaagacctacacaacaagctgaaaaagttaggtgcttatcacatcaggattctgtactaccttcctttaggaaaaaaatattattgaaatactaaattgtattgaaacattgtttttaaaagaattaggcaatgcatggaacatacttttgagtctttttccctgagtttcaaaacacaattcagttgtttcctttccaagaagtcaaacaaatattgttatttacaaactaggcaaatagcatcaagagaagaaaatatatttctttttactttttctgccactgaagatctactaacactagcagagaagaccattaatacataataaggccacattcaatgccccatgatttttattattctacatcaacttaaacaggggaattctaattcttttgactatgcacttcctctttttccattttcttttttttttaattaatgttaaaactttcagagctacaatattgcaatctattctttcaaagcactatttgcctattaaaagaaattccaccaagttcagacattaccttagcaatacagtagaatatttctctactaataaaaaaatcaactcctgcagttttaaccaacacctatgtgtaaatagtcttcttatttatatcacatttacaacatttccgctactcagttaaggtgcataagagcagaaactgtgacttctcagcactaggacctagccagatagtcattgccctgttcaaaataagtttaacaactgttaaatgacaagtttagatggtgccatctgaatcctccataagcactgcaaattcagcatttcattctcccattcttacttatctgtgttgattgcttcaccacctacccatttgttaaggtcaaaaatgttggcttcatcaatggctgtacactctcctccctttgaaattcttaccctattatttgcctagtcctacagattctctgcgaattctctattactacacaaatttagctttcattattactcatcaaaatattacttttgtctctttcattgtcaccaatagaatgccttctctaccttctccaacctatttcattataaagctagttgtgcttgctttctaaaaagtggatatgcttttgctttcctcccagtttcccctctgtttagatttttaatggctcccgattttctgtattatctaaatgctcagcatgtcctactggacttcactactacctttaaataacagctccccgaccagctcttgcctagactctccttgtgccttatatgaacaacaaatgtctctgtcttaagttggtttccccagaagcagattctgagacaaagatttgagtaccggtgctatattatttgggaaatgatcccgggaaacaacaaatgtctggagagagataaagagaaggaaagagaaccaataatttgtgccttgtcaagcaggtgttagaggtagggcaactgagttcaatctcattggggagtcctaaaagataatgaggaacactcttccttattatccaaccccaacccctcctgcctccaagggcaaggaaggtagagtgtgtattctccaatccatttgtcactggccaagaactgctactgcatacattcatcacttaccatttccagcctgcccaataaaaagaaagtctcaggtagagagttacaggtgattctagcagaatgccagaatgacatgggtaggcattgatgcaggactgattttatgcacataccacacagcctcacgtatacactattgttgtacataaactgttacttgtgtaggaactctcattgttgttgttccagtgaaattctactcaatctttaagcccaatgtcaaaagtcactctgattccatttctgaggaagaattaatgattcctcctgtacttccataatacttccttggagattaagatttcaacttgtactcatggttccacctttgtatcactatgcaatgcagtaatctccatttgacaaatcaggaaacagtcagaaagatcatgccagaaattacatgattcctaaaagttggagtgtggaactccaacctagccctcttaaaaatctactttgcccaataaatcagatatcctcaacctgaactgactatgtatctgctatattaaataattaaagaccaactggcctaaataaatgccctgctattcagagaaccagcactgcaatgtggaacagatctacctgccttataagcaagaagtccagtttctccttcttcaggctcttcactcctctggactgttcataatcatgagggtttcacaaaccaaaacaagaaccttacaaacttccacactcaagcctgcaaagacccagtatctcaagtaagcacttccattgggtcttgttgcagcatggtggacaatggaatgtggccccacagtctattagtcaatattggtctcctgctatggtcatctcactgctctagatgctttccagctgttcttcaaggaagcacactgaagcagtaagtgctcagtcctttcagtctcctacacagtcaactcagggtgttcttagttccaggcagcaggacagaatggttcaagcacctgtcacttcgtatgagtagtgctctttttccttcccttcctttgcttcttatccccatctcttgagccatcatgtcaatatcacactggttgttctttttaactctatttacaggtatgaatctcagcccacaaattcaggtgagcaagaaatctacagtctttacattataaaactttattttttgttgtaagagccgcctttctcgcatgactagtgggaaacttaaactcagtcccattcatgattttctgtcccttagtgggttctcagagagtgccttgggattaaggagtgggatctctcttatccttaagcatctgtccacacacagacagctactgagacaccctctgtctttctccacacggcccctctggcatgctggctcactcctgccaggcacacttgggacataaaacctttctctgagtttgtccatggaaaccatcttctcaaataccccatacagtcatttcctctcaggggttttccaacactcaaccttacttctgttgactgaggccttggtctctaccacacagggacttttacaaactatcttgctttctccttgcaagtggagacacatctctctagtcttacaggctttagtccagctctccctactgcttctggccaagatactctgtccagcctgccaattctctcttttctgtggggcttttaaaggacagataaactaactaataaaaagccagaaatattggagtgccatttgttctttctgctttttaacaccccttccctgagttgaatgagaggaagagatccctgagttgaatgagaggaagagaatcagagattcagggagaaaacaattctagattaatattacaaatgatttctccagatatacctagaaacacaaagaaataattatagccatttcatcccattggggttgttaactctgtccttactctacttaagctaatatcctaaatccttgtgcactaatatcctctttatatcccacttcctctccaaaatatatcctctttccctgctcctgttcttgtaggagtaattccagaaggccctgaccatcgctccccttttagggaggaattgctccctaaaagtccaaggtggttttctggctacaaatgtattctctaatgggatagtctacatgaaacaacagaaaacaaaattaaatgtgtcaattgatgtaacttgataaaccttaatatcaacatatttgctaccaaaggatgtggaaaaaggagcaggtggagattaaccagtgattaggaaacaaaattctgagtcagaacctggtcttctgtttcaaactttatcccttcatcataaaatacatgcatgtttctagataacgcaaccctttactcttttccaaaaggggaaaaatatctctgtgagtgtctattcctaaattctaacaagtgtcatcttagaaaacaaacaaaaaaaaattagaaaattgctgaacaatcctgctagctgctattcagttatgaagatcatagtcattctgttcgtgagatactctagagatgttattcagaggctgcttaggagaaaaaaaagaaaaatgcaaactgttagatctcagttaaataactgagtttattgcaatttaagctaatagttattcagtattcagtcaactatttggtgcaaacaaataaatattcttccacttgttagtccctaggggctttcttaatcctatctgaatttactttctgtgaatttctgagtaatcagaagttataggttggatacatcttgtgctagggacacccatggtgtaactgcttcattttttcttttcatttcaaaggaaatggtccatccaaagtgaaaattgttgtgttttatttttttttttggtggtagagtatattttcctctttgttggtgttgttattgttgctgttgttttaatcagatagttatttcaaacagaagcaatcaagttccttttttcactgccatctccctctacccttcctactcaatccatgctgttaagaaaatatccttgttagtaatgtgacataaagcagccttaaaaatccataattcagctgggtctagtggcttgcacctgtaatcacagcattttgggaggctgaggtgggaggatcgattgagctcaggaattcaaggctgctgtgagccatgatcacaccactgcacttcagcctgggtgacagagccaagaccctgccataaaaaaaaaaaaaaagattcaggcccggtttggtggctcacacctgtaatcccagcactttgggaggcctaggcaggcggatcacctgaggtcagagttcgagaccagcctggccaacatggtgaaacccccatctctactaaaaatacaaaaatgaggccgggcgcagtggctcacacctgtaatcccagcatcccagcactttgggaggccgaggcaggcagatcacctgaggttgggagttcgagaccagcctgaccaacatgtagaaaccctgtctctactgaaaatataaaattagccatgcgtggtggcacatgcctgtaatcccagctactagggaggctgaggcaggagaattgcttgaacctgggaggcagaggttgcagtgagccaagatctcgccattgcaccccagcctgggcgacagagtgaggttctatctcaaaaaaaaaaaaaaaaaaagattaataattatttttcatcagttcattcagtcttgtaattaattcttgctgtgatctgtattagcaatttcacaaacccatcagtttcttcattcgagttttggaattttttttttttttttgacagagtttcactcttgttgcccaggctggagtgcaacgacagaatctcagctcactgcaacctccgcctcccgggtttaagcgattctcctgcctcagactcctgagtagctgggattacaggcatatgctaccacgcccagctaatttttttgtgtttttttttttttttttagtagagacgggttttctccatgttgatcaggctggtctcgaactcccgacctcaggtgatccgcccacctcggcctcccagagtgctgggattacaggcttgagccactgtgcctggccgagttttggaaatttagttcaatagtgtgaactcaaagttattagaaacccgtacttgtcagacttcattctttccatgaagctccttgaagacataactctctgggattataattgcctgcaagaagctttcagaaagacattagactaaagcaattaagtgtggacatgaagacttcaagtgaccatggccaaaacctggtctgagtccatggtaatgacgacataattgacaagaatgttatttctgaaccaaaattgactgataccatttataccaagacacatcagatttttaaatatgttatacaatttttcagtatattaataacatatccatataaatatacctcaaggtgaaatatttcttattttgccaatccttctcttataatttattttatgtatttcttttttttttttttttgagatggagtctcgctctgtcacccaggctggagtacagtggcgcaatctcggctcactgcaagctccgcctcccaggttcatgccattctcctgcctcagcctccagagtagctgggactacaggcgcctgccaccacgcccagctaattttttgtatttttagtagagatggggtttcaccgtgttagccaggatggtctcaaactcctgacctcgtgatccgcctgcctcggcctcccaaagagctgggattacaggcatgagacactgtgcctggccttattttttattttatatttaaaatttttaaattttttggccgggtgcagtggctcattcctgtaatcccagcactttgggaggccgaggtgggtggatcacctgaggtcaggacttcaagaccagcctggccaacatggtgaaacccggtctctactaaaagtacaaaaattagccaggcaggatggccggcgcctgtaatcccatctactcaggaggctgaagcgggagaatcacttgaacctgggaggcggagcttgcagtgagccgagatggcgccactgcactccagcctggcccacaagagccagactccgtctcaaaaaaaataaaaataaaaataaaataaaattttttttgtagatacaggagtctcgatattttgcccagactggtctcaaactcctgggctcaagcaatcctcctgccttggcgtcccttgggattacaggcattagccactgtgcccagcctcatataatttaatatatcagataagcccagttgatttaatatttctttttttgtagatcctttgagaggttcaggggtcctctggaacatcctaaagttagtttgaggtcaaaaatacttaattttgatttttttttttttttgagatagggtcttactctgtcaccctggctggagtgcatggacacaatcatatctcactgcactctcaaactcttgaagcaagtgattgtcccaccttagcctccagagtagctgggtctacaggcatgtgccaccacgtccagctaattttgtttattttttgtagagatgggatcttgttatgttgcccaagtgggtctcaaactcctgggctcaagcaatcctcctgcctcagcctcccaaagtgttgggaattcaggtgtgcgccactgtgtctgccttaattttgatttttgaaaagtttgtcaaatatcaaagttttaaaacgcttgatcaaagtaggatcacaagtcactgtgaaataaaaccaaagtgagaaaatatttgaaagacacaaaacacaataaatactctttttttttttgagagggagtcttgctctgctgcccatgctggagtgcagtggtgtgatctcagctcactgcaacctctgcctcctgggtttaagcaattctcctgcctcagcctcccaagtagctgggattacaggtgctcgccaccataccggctaatttttgtattttaaggagagacagagtttcaccatgttggccaggctggtcttgaactcttgacgtcaggtgatctcactgtcttgccctcccaaagtgctgggattacaggcgtgagccaccgtgcctggtcaatttttttttttttttttttttgagacggagtctcgctctgtcacccaggctggagtgcagtggtgtgatctcggctcactgcaagctccaccccccgggttcacgccattctcctgcctcagcctcccgagtagctgggactacaggcgcctgccaccacgcccagctaatttttttgtatttttaatagagacagggtttcaccgtgtttgccaggatggtctcgatctcctgacctcatgatccgcctgcctcagcctcccaaagtgctgggattacaggcgtgagccaccgcgcccagccctggccaatgttcttgatgaaacagattctctgtttcctaggccagttacctaaaaggtaaagaaaaatcttttacaattttcttgtaaagggtagatcaatggtccacaaaaactctgttgttgcaacacaggggcccaaattgcggccttgtatccatcagtgtgcttttgatattaacgctcagtttttagcctaggcaacatgggaagacctcaccgctactaaaagtaaaaattagccaggtgtggtggtgcacacctgtagtcctgtctacttgggaggctgaagtgggagaatcacttgagcccaggagattaaagctacagtgagttatgatcatgccactgcactccagcctgggtgacagagtgagaccctgcctcaaaaaaagcttcaattttaggccaggcgcagtggctcaggcctgtaatcccagcactttgggaggctgaggcgggcagatcacgaggtcaggagttcgagaccagcctgaccaacatggtgagacccccgtctctactaaaaatacaaaaattagccgggtgtggtggcacacacccgtgatcccagctactcaggaggccgaggcaggagaattgcttgaaccagggaggtggaagttgcagtgagtcgagatagagccacttcactccagcctgggtgacagagtgaaactatctcagaaaaagtaaataaataaaataaataaaggaaaagaaagttcaatttttagaaaatcttataaatatttatggctttttttttttgagatagagtttccctcttgtcacccaggctggtgtgcagtggcatgatctcggctcactgcaacctccacctcctggattcaagcgattctcctgcctcagccttgtgagtagctgggattacaggcgcctatcaccatgcccagctaactttttgtatttttagtagagatgtggtttcgccatgttgagcaggctggtctcgaactcctgacctcaggtgatcagctcgcctcagcctcccaaagtgctgggattacaggcatgagccaccacgcctggccaaaaatcttataaataatccccttctaatttcggccagcttaatcacacaccaaattcctttcatgagattaatcttccacaacttctacacttccttaaatctttgattttgtcctatacttctttttttatattagcaatctactttaggacagaaatttactttcctttcctcttgattttgaccaaagtcctctcttatgcaaaatgaaaaattactcttttttcaactttctttaccaaaaatacatcctcatatttataactttttttcacatctctcctacttactggccttcttcccaccttgtttctatttccttcctaaatccatattttgaaacaatctttaaataacccccaacttaaacaaaattgctcttatttaacaaaaaacttatctcaaaaaacctagcacggtcaccaagcgtgctttgcttttctttctctctcttttttttttttttggaggcggattctcgctctgtcagccatgccggagtgtaaatggcgcgatcttggctcactgcaacctccgcctcccaggttttgagagattctcctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcaacaagaactgcatgctgggttctggacagaaatagagttataattaagcattcatcaggctgcattttggcccacttccttgttgctaaaagtcaggtggcactagttcctgaccattgcataccattgttcctgtagataggatttctgacattagagtcagaagactgttttaagaatttatttggggatcttctggggctgtatcacagggggaaaagtgaaattaaaaaaaaaaaaaacacaatcaatttgggctgggcgcggtggctcacacctgtaattccagcactttgggaggctgaggtggagggatctcttgagcccaagagttagagaccagcctggccaacatagtgcaactccatctctaccaaacaaaatataaaaattagccaggcatggtggtgagtgcctgtattcccagctccagaggctgaggtgggaggatcacttgagcccaggagttggaggctgcagtgagatatgatccagctactgcactctagccagggcaacagagcaagaccccaactcaaaaagaaaaaaaaaaggaatttagattaaaaaagaaaaagggctcgagtttgaatgcagtggctcaagcctataatcccagcactctaagaggctgaggtaggaagatcgcttgagctcaggagtgccaggctgcagtgagccgtgatcatatcactgcactctagcctggacaacagagtgagaccttgtctctaaaacaaaacaaaacaaaacaaaacaaaacttgagaatgggccagacgcggtggctcacgcctgtaatcccagcactttgggaggccaaggcgggtggatcatgaggtcaggagttcaagaccagcctggccaagatggtgaaacctcgtctctactaaaaatacaaaaattacagcgtacctgtaatcccagctactcgggaggctgaggcaggagaatcgcttgaacctggggggcggaggttgcagtgagccgagatcgtgccactgcactccagcctgggtgacagagcgagactccatctcaaaaaaaaaaaaacaaaaacttgagaatgatagtgttacaggaaaggggtccctacccagaccccaagtgagggttcttggatctcacgcaagaaagaattcagggcgagtgcataaagtgaacgcaagtttattaagacagtagaggaatgaaagaatgaccattccatagacagagcagccccgagggtggctggttacccatttttatgattatttcttgatgatatgctaaacaaggggtggattattcatgcctcccctttttagaccacatagggtaacttcctgacgttgccatggcatttgtaaactgtcatgaagctggtgggagtgtagcagtgaggacgaccagaggtcactctcgtcgccatcttggtcttggtgggttttaaccggcttcttcactgcaacctgttttatttatttatttatttatttatttatttatttatttatatattttttgaaacggagtctcgctctgtcacgcaggctggagtgcagtaccgcgatctcggctcactgcaagctccgcctcccgggttcacgccattgtcctgcctcagcctcccgagtagctgggactgcaggtgcccgccaccatatccaactaattttttgtatttttagtagagacgggatttcaccgtgttagccaggatggtctcgatctcctgaccttgtgatccgctcgcctcagcctcccaaagtgctgggattacaggcgtgagccaccgtgcccggccatcactgcaacctgttttatcagcaaggtctttatgacctgtatcttgtgccaacctcccatctcatcctgtgacttagaatgcctttaccatctgggaatgcagcccaataggtctcagcctcattttatccagcccctattcaaaatggagttgctctggttcacccgcctctgacaatagtagaagttaaaaaaaaaaaataacttctttaactccactccaggtggcatttcttagtgcctctgaaggttctgatctagaaccagcccccagctcacccagagcaaggaaagatcatgaaaacccaagcagaagcaagacactgggttccagcatcaatgctaagggctagaacattttctgatgttttgcttggaaaggcagaatttggttgtctagtgcgtccactaattggcctccatctgacaccctggagggatgggctgattagaagccacagctgctttgctcattatttctgatgaatggacatcacctggcgtctccggtgatggcgccagctcaggacccaggtgtgacctgcacaacaaagaaaagcaagatagctttgcagccaacatggtgaaaccccatctctattaaaaatacaaaaaaaaaaaaattagccggacgtggtggcgggcgcctgtaatcccagctactcagtaggctgaggcaggagaatcgcttaaatctaggaggcagaggttgcagtgagccaagatcatgccactgcactccagccttggcgacacagagagactctgtctcaaaaaaaaaaaaaaaaaaaaaaagatggctttacagccctgaggagtaaaccagtcttccccaaataattatcttatgtaagtcccagccccttggaacatgttttgaaagggctcacccatctgggcaggtgactcacgcctgtaatccctgcactttgggaggctgaggcaggcggatcacctgaggtcagaagttcaagaccagcctggccaacatggcgaaacccatctctactaaaaatacaaaaattagccaggcatggtgggacacgcctgtagtctcagctacttgggaggctgaggcaggagaatcacttgaatatgggaggtggaagttgcagtgagccgggatcataccattgcactctagcttgggcaagaagagtgaaaccccatctcaaaaacaaaagaaaaggctcacccttttcactggttcccttgtggcaaatctaaaataaggtacgtgtgctcgccgttcattcatctgaaaagttctaacagtttgcaaataccctctacccataccccacccccacgtgttgtccttttttttttttttttttatttgagacagagtctcactctgttgcccaggctggagtgcagtggcgcaatctcggctcactgcaagctctgcctcccgggttcacgccattctcctgcctcagcctcccaagtagctgggactacaggcgcccgccaccatgcccggctaattttattttattttatttttgtatttttagtagagacggggtttctccatgttagccaggatggtcttgatctcctgaccttgtgatccgcccgcctcggcctcccaaagtgctaggattacaggcatgagacaccgcacccggcccttttttttttaagagacaagatgtcaccctgtcacccaggctggaatgcagtggtgtcgtcatagctcactgcagcctggaccccctgggctcaagtgatcctcctgcctcagtctcccaagtagctgggaccacaggggtgtcccaccacacccagctaatttttttattttttgtagagatggggtcttgtcttgtcacccaggctggtcttaaacttctgagctcaagcgatcctcccacttggacctagccaggtgctgggattatgggtattagagtttaaatttctttgctcaacaccactccccattttgtggccaacagtcacattctttcttgggccacgtcattcattttcagttgcttcagagcactggtggccccttgggtgtgttgaacaaaccccagcctttgaggagttcaaaaaaaaaaaaaaaaagacaccatctctaggcggaaaatttcagacaaagaacccctgccaggaatatttcctgccgctgctcctgccactgccccttaggctgtggacctttatgcaagaacgcaagtggcaaactgccctactgtgtatgttgtggggagtgggggtactgccagagaggagagagccctattttattttattttattttattttaaagacagagtctcactctgttgcccaggctggagtgcaatggcacgatctcggctcactgcaacctctgccccctgggttcaagagattctcctccctcagcctccccagtagctgggattacaggcgcatgccaccacgcctggctaatttttgtatttttagtggagacggggtttccccatgttggccaaactcctgaccttatgtgatcctcccaccttggcctcccaaagtgctgggattagaggcatgagccactgcgcccagctgacagccctctctaaatctttaaaaattcagtcaggcgtggtggctcatgcctgtaatctcagcactttaggaggctgaggcaagaggaatgtgtgagcccaggagtttgagaccaacttgggcaatatggtgagaccctatcttgacagaaaatacaaaaatcagcctggcatggtggtgcacgcttgtagtcccagctactcaggaggctgaggcaggaagatcacttgaacccaggaggtcgaggctgcagtgagctatgatcacgccactgtactccagcctgggagacactgtctcaaaaaataaataaataaaatctttaacaattcttcagcttatccccctaccttctggggcttcttgggtctcttcccagaaactttcttcgtctgtaagcccgtttattgtatgcaattgtttaaaaaacacaaatgggtgcatattctcatattctctaccctctattttgaacgttccttttttttctttttttcagaccgagtctcagtctgtcacccaggctagtgcaatggtgcaattttggctcactacaccctctgcctcccagattcaagcgattctcctgcctcagcctcccgagtaggtggattacaggtgtgcaccgctgcacccagctaatttttgtatttttagtagagacgaggtttcaccatgttggccagactggtcttgaactcctgatctcaggtgatccacctgcctccgcctcccaaagtgctgggattataggcatgagccgccttgcctggctcaaagttcctttttggtttaacaatagatctaggccactgtgagtcttcctcattccttctagggctacctagtgttccggggttatttaaccagccccctcctaccaggcagttcttttgtctctggccctttgctacgtatattagtttaaagttcactttgcaagtggccaaggctgtttccctcatttccaggttcccagggggcagacatcctgctgcaatttcagaagtcagcacactcttctctctcctgtctaaaatacaaaagtccatgccccccactctccctcttgatactgtcctattttacttcttttcacaaccagaactctttatttttcccaaataaaaatagtccgtcttttcagattttaaaaatggaactctggccggatgcggtggccctcacctgtaatcccagcactttggaaggctgcagtgggcagattacctgaggtcaggagtttgagatcagcctggctgacatggtgaaactctgtctctactaaaaatacaaaaattagcccggatgcggtggctcacatctgtaatcccagtactttgggagaccgaggtgggcagatcacgaggtcaggagttcaagaccagcctggccaacatggtgaaaccctgtctctactaaaatacaaaaattagctgggcatggtggcatccgcctgtaatcacagttactcggcaggctgaggaagaattgcttgaacctgggaggcggagtttgcagtgagctgagattgtgccattgcactccagcctgggcgacagagcaagactccatctcaaaaatatatatatatacaaaaattagctgagtgtggtggtgcatgcctgtaatcccagctactcgggaggtgaggcaggagaatcacttgaacctgggaggcggaggttgcagtgagccgagattgtgccatttcactccagcctggacaacaagagcaaaactcgtctcaaaaaaaaaaaaaaaaaaggaaaataaaaatccctgataaaggatcaatgaccttaggataatgtcattccaggtaagtatctttaactgggtacttggtcctccaagattcagaggaccttgatccccctgaaactgtatacataatattcaacatacatagtatgtgcacacatgtgcaaacactcacattatctaaaattcatcataatcttaccccggcttctccccatactcctcagatcctgctatagcctagtgcattttctccttcctcactcccttccctccatgtgtcctctgccctggccaccaggaactttgtgctgcctccggagtgcatgaggcactttcacatctctcttgctttacaagagcttccctatgctccaactggcaaatttctctatggactgaaaaacccacatagcctttatctgtcttgtgatgtcttctccccaccctcaagttaggcatacccttctatgccctcctttatccaaacattttccccactatatcgtaattgtgtgtttaagtgccggactttccaactagatacaaagctttcccaggaaagaaatccttttcttttcttctttctttcttttcttttcttttctttctttttttttttttttttttgagacagattcccactgtgtcgtccaggctggagtgcagtggcacaatcttggctcagtgcaacctccacctccagggttcaagtgattctcttgcctcagtcttccaagtagctgggattacaggcacgcgccaccacacccagttaattattattattattattttttttttttgtttttgagacggagtctcgctctgtcacccaggctggagtgcagtggcacaatcccggctcactgcaagctccgcctcccgggttcacgccattctcctgcctcagcctcccgagtagctgggactacaggagcccaccactacgcccggctaattttttttttttttttttttgtaattttagtagagacggggtttcacagtggtctcgatctcctgccctcgtgatccgcccgcctcggcctcccagagtgctgggattacaggcgtgagccactgcgcccggcctccacacccagttaatttttgtatttttagtagagacggggtttcaccatgttggccaggatggtctcaatctcttgaccttgtgatctggctgcctcggcctcccaaagtgctgggattacaggcgtgagccaccgctcccggcgagaaaccttttctttttcttttttcttcttcttcgtctttttttttttttcttttgagagggattcctgttccgtcgcccaggctggagtgcaatggcgcgatcttggctcactacagcctctgcctcccgggtttaagcgattctcttgcctcagcctcccgagtagctgggattacaggcacgagccaccacgcccggctagtttttttttggtatttttagtagagacggggtttcgccatgatggccaggctggtctggaactcccgacctcaggtgatccgcccacctctgcctctcaaagtgcagggattacaggcatgagccactgcgcccagccaagaaaccatttctgattcacctattcactcccgcactcccactacacagtagctaaataaataaataaatattaaaaataaataggaaagaaagagagaaaaaaagaaaagaaaaagacaaaaatttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcgggggggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggaggagtttgcttcctaactctgcttccctgctttcctgtggggggtcttcccaggagttcctggggccctgggtcactttttggggtgcgtaaggggtgccgaaaaagatttagaactcggttcccttttctggagctgcgctttcatcgcgactgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtagactttctggtagccaccatccgggcttaagccatccggatagcaagccctctgattcggttgctctgtgaccttaaatatttaccctctctggtgtgttgatttcctggatgcttagctgccagactggcttatgaagtccttttagagttttctgtaaaagggctcaggccaggcacggtggctcatgcctgtaatcccagccctttgggaggccgaggtggaaggatcatttgagtccaggaatttgagacaagcctgggaaacgaagaggattcctgagatcactgtctctataaaaaatcagatgggcgtgttggtgggtgcctgtagtcccagctacttgggaggctgaggcaggaggatcgcttgagcccaggagttggaggctgcagtgagctgtgatcacaccactgcactgcagcatgggcgacagagggagaccccgtctcaaaaaacaaaaaacaaacaaactaaaaaaacgaactttttttttttttaagaaaagggctcagagccaggcgtggtgactcgagcctataatcccagctactcgggaagctgaggcaggagagtagcttgaacctgggaggcggaggctgcagtgagccgagatcacgccactgcactccagcttgggtgacagagcaagactccgtctccaaaaactaataataataaaaaattttaaaaagagctcagggtttttttgtttgtttgctttttgttgtttcttcaaccatctccttgattgttaagtgggtggaggaagactgttgtacctcgtgctccacccaggctattggaaaataaatctggtgattttcagtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggtgagagccatggggacttgaccttgctgccttctctgtctggtgcagagaaggtggggattggggagggtggaatttgaggtctgcaggataaacgtgtgccctgggagttgactgttgattgccacctgtctcaaataaattgcagtggcgtcttgccactgcttctcctgtttaactaactagtcttagaagatgctttccactttaagacatgctttatgggatagaagacacaagtcacgatttctgcatttgaagtggcagttttcatttcttttgttgcataaacccttactgggtgccagataagatctctgtcttttgggagtgcattgtttggtggaaaagacaaagcagagtcagtgacaaggtgttgtcagtgtgatatatactgagctgggagaaatcacaaggctctcctacccacatccagaaaggggacggttagagggaaggtcaggaaggcttctggaaggtggtagttgaggggggttgtgaaggaggagtaggacttagaaagtggggcacagtcgcctgggagaggagtcagcgtttgcaaagtcatgaagctaccgggacacagctgggctactgtaagtagctgagtatgtaatagaggaggctggaaaagcaggcagagggctctgagcgaggagggttatgtgggccatgccaagactcgggagtggaaggattttaggagatttccatgagggtcattttattaattatttttttgagttggggtctgcttctgctgcccaggctggagtgcagtggagtgatcatagttcaccacagcctcaaattcctgggctctggggtagctgaggtgcctaccaccatacccgactaataattttatctagagacagtgccgctctacgttgtccaggctggtctctaactcctggcctcaagggatcctcccatcccagcctcccaaagtgctaggattacaggcctgagccaccgtgcctggcctcgtgagggacattttaaaggagcacactggaacatgtggaatgggtttagactggattattcgctttgtggcggtcttcttacatcatgccagcttcttcgtggggagaggcaggtgagtggttttgccctcagttgcttatagtctagttgaagagataaagtggacatagagaactgaaaaggaacttgctaagagggtgttttctttcattctttttgttgttgttgttttgttttgtttgtttactttttgagacagggtcttactctgtcacccaggctggagagcggtggtgcaatctcagctcactgctcaacttcacctcccaggctcaagagggtcttgtgcctcagcttcccgagtagctggacttacaggtgcacaccatcatgcctggctgatttagagggtgtttgctttctgctgggcacgtccaggcatcgtgggaagtgctgtttaaattgggccataaaagggtgggtaaggtgaggacaggggaccaagtgggtgggattcagggtggagcagagtcatgggggtcgggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggtgtgtaaaagacaggatcagaacgttagttcaggaagcttaatcttttctgcccccccatctgagatgtacaagagggttagaaagcagagttggagaagctgtttgggagggagcacttatttgtttttttgttttgttttgtttttttgagatggagtctcgctctgttacccaggctggagtgcagtggcgccatcctggctcactgcaacctccacctcccgggttcaagtgattctcctgcctcagcttcccaagtaggtaggactacaagcacctgccaccatgcctggctaatttttgtatttttagtagagacggggtttccctctgttggccaggctggtgtcgaactcctgacctcaggtgatgcacccaccgaggcctcccaaagtgctgggattacaggcgtgagccactgcgcccggcagggagggggtaaagtgagaggcataagggtcccggccaggtgttagcagggggcttcagaggtgaggagagagcagggcaggcagctgctaggcctgggggagcgggctgcggaggactgagaatctgaggtttttctcttggccgcctgggggaaatccagggggaaaaggagaatgaggaaggaagatgcgtttggcctcagacgtgttgaaggtattaagaggccaacaggaaatgaggccatgggctagagagaagagccctgattcattccccaaatgcctcccgaaattctgtgcgccgaggcttgtgtttggcacttggagtacaaagatgaattcagcagtctctttggtgtttgccttatcagctaagctgagaacaagattgattagtacacactcctcagtgttcatgcctgacctacttttccttatttagtaagttatttttaataaatgtagtaagttctggcaatctaggcacccaaaacaaaagctgggatcatgaaacaaaagtatatatctaatcttttttttttaattttaaaaaactttaaaaagttttctactttatcaggtccccttagaacatctaatcatttcatttgaacttgttttctgttcttaccctgaggtaatcattatctcctttctttcattttttttcttagttttatcttacatgtgtatttctttgtttctctgtctcttttttttttttctttgaggcagagtttcactcttattacctaggctggagtgcaatggcacgatctcggctcactgcaacctccgcctcccgggttcaagctactcccgattctcctgcctcagactctggagtagctaggattacaggcatgcgccaccatgcccggctaattttgtatttttagtagagacagagtttctccatgttagtcagactggtctcaaactcctgacctcaggtgatccacccgcctcggcctcccaaagtgctgggattacaggcgtgaggcaccacgcctggcctatttctttctttttttagagacagtgtctcgccttgtaacccaggcagctggagtgcagtggcatgatcacggatcactgccgccccaaattcctgggttcaatggatccatccccttcagcctcctgaatagctgggactacaggcacaggctaccatgcttagctaatttttaaagtttgtgcagaggcagcttcactgtgttgcccaggctggtgttgaactcctgggctcaagcaattcacccgccttggcctcccaaagtgctgggatgatagacatgagccaccatgctcggcagtgttcatctttcgtagctattgctagaccatttcctgaatgaagtgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgattttaatccttcgtgtctattgcaaatatcttctcccagcttttaacctattattcctctttctttaaggtgtcttctgttgatcagccattcttcattttaacatagcgaaatgtattttttccctagtactcagttttctgggtctggtttgaagtcttttcctgaacataacccttgcctttaaggagcgtatgcattctccagtggaggagacagataatggcactgagacgtcatgtgggcattgattgttagaagtggccacttctgcctgtggagcgggagcgaacttaggaaagatctcacagggcagagtcttgagctaggaattaagagatgagtaagtggacaagtgcgatgggcattctcagtgggggacgaagggcatgaaacatcctgacctgccctgggcgctgccaggaggtccagatggcaggagctgatggtttgaggggctcgggcagggcatcccgaggacagctttgggtgatctgtatgcaagggaatattgaagccatgggaacagatcctgaggatccgggcggaatggagagaggaggggaggaggggagagggaggccagggcctgattcccggatgcagagaatgttatcaacgcctggtgtggctctggggagcacctgggacttcccaggggcgggtgctgttggcatgctgcctgctgtgctgttggatgctgtatttcacccttaggtgttgggcaaaggctgacatgtctgcagagggcagggcgtgttgttggcaaagctagccagaggcagagcactctctcactttttgatagagacatgagttcagagaagtattgctcaactgtaggagtgtgaaagtacagtaatagatgtgagggaggccacagggcagaggtctgcaaacgatggaccctcagccaaatctggcccactgccatttttttttttttttttttttttttttttttgagatggagtctcactctgttgccaggctggagtgcaatggcacgatctcagctcactgcagcctccgcctcccaggttcaagaaattctcctgcctcagcctcctgagtagctgggattacaggcaccagccaccatgcctggctaatttttgtatttttagtagagacaaggtttcaccatgttggccaggctggtctcgaactcctgacctcaggtgatccacccccgcttggcctcccaaagtgctgggattataggcgtgagccaccacgcccagcattttttttttttttttttttttgaggcagggtctaactcctgcccaggctggagtacagtggcacagtctcggctcactgcagcctccgcctcctgggttcaagtgattctcctgccccagcctcccaagtagctgggactacaggtgcacgccactacgcctggctcatctttgtatttttttggtagatacggggtttcactgtattggccaggctggtctcaaactcctggcctcaaatgatccacccacctcggcctcccgaagtgctgggattacaggcgtgagctaccgcattcagccccactgcctgattttgttcataaagttatattggtatgcaacccctcctgtttacacattgtttatggctgttcttgtggtctagtggcagagtcactggaaagactttttctgtcctttacaggaaaagcatgctggccctagccatagggagtcgtggtagctgtggccacccagagaggacgttccagccaccattgcagtttagctggtgttgctaggtagatcatggatctaggtccagcctgcaaatattgccatcttttctgattttcaagggaagcttgaaatctagatttttttttttttttttactgtgaatattccttttttttgagacagattctcactctgtcgcccaagctggagtgcagtggcataatcttggctcactgcaacctccacgtcttaggttcaagcaattctcctgcttcagcctcccgagtaactgggactacaggcgctcgccaccacacttggctaattttttgtattttttagtagagacagggtttcactgcattagccaggatggtctcgctctcctgacctcatgatctgcctgcctcggcctcccaaagtgctgggattacaggtgtgagccactgagcccggccaaatattccaatttttaaacatcagctcagtttttaaaagccaaaccttagtaacccaagcaaaacacatctacaggccagtttgtccgtcgtcagtctgtcttggtgggaaagacaggaactctggaaacagatttgggttttctcagcccctggatatccttgggcaagctgcatgtcttctggtgactcacttttctcagttgtggtatggaaatatcccgcttccccagttgtgaggaccaacgagaattactagtcaggtggaggggcttagcacggtgcctggtgcctggtaaacctttacctggtagccattgctgttattcatttatttatttattttacacaataatttacttattgagagccttctctccccgcccttgcagtctctaggtcactttttccacttgtagattttgtgcccaagccccagaaagatggctgggggcaggggctctgcgtactattcgatgagacccataacgtggctgtaactgtctttctcatactgcaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgcttttcttgggcataaatatctgatttctggtttccattcggtctttttttttttttttttttgagacggagtcttgctctgtcgcccaggctggagtgcagtggcgcgatcttggctcactgcaaactccacttcctgggttcacgccattctcctgcctcagcctcccaagtagccgggactacaggcacccgccaccgcgcccggctaattttttgtatttttagtagagacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttgtttaaagagacagggtctcgctctgttgcccaggttggagtgtagtggcacgatcatagctcactgcaactttgaacccctaggctcaaagcagtccttctgcctcagccagtcaaagtgctgggatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacacagcggtggtggtggtttggtttatatttatgaccttttaaaagtgtttggcattttcagggaggtttgttttttgttttgttttttgaggctcatgttgcccaggctggagtgcaatggtgcagttctcggctcactgcaacctccgcctcctgggttcaggggattctcctgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaaaaagaaaaaaaaaggtcttctatcgtttctccactcaaagacagctgttaacattttattgacttctatggagtttgccctatgcttctgttttatgtaatagagacagtgctgtagtgaatagcttcacgtcaacatttttctataattttctgaagttagagtcttaattattggatcaaaggaagtgaacatttttaaacctcttgatacatatattaccaaattgtttgcttttccgttttttttaataaatagagatgggggtctctctgtgttgcccaggctggtcttgacctcctggcctcaagcgatcctcttccctccacctcccgagtagctaagattataggtgtgagccaccatgctcagccgctgattttaacttgtatgttttaaacaaaatttctagtaaagtagaacatttctttgatatgtttgtgtcaggatttgactctcccaggtctttggagaggctttctaacaaggcatcccccgtgggtggccatctgccctgtgagaaggtcatttctagttccaggtcacgcacagtgtgtcagctggtggggtgtggagtttcaggcccaggcctcctggaaagtgcccgaaagagaaacggcttagaaaataaggactttaacggtggtgtgggttgagtttggaaagtttagaccatgttagtggaatcagagctgggaagaggttctagaagttacctcctctcactggtttccagtccacacttctcagaactctcccattttgcagtcaggtgcagtggctcacatctgtaatcctagcacttgaggagaccgaggtgggcagatcacttgaggccaggagtttgagaccagccctggccaacatagcgaaaccccgtttctactaaaaatacaaaaattagccaggtgtggtgtggtgcacacctgtagttccagctactcaggaggctgaggcatgagaatcacttgagcctgggaggcagaggttgcagtaagccaagatcgcaccactgcactccagcctgtgtgatggaaggagactctgtctcaaagaaaagaactcacctattttgcaaaggagcttcatggttctcttgaagaaaaataggaatggaggccacctctgtgtcaaaaacaacatcccacatttctgtgtttcactttttttttttttttttttttgagactgagtttcactcttattgcccaggctggagtgcaatggcgcgatctcggctcactgcaacctccacctcccgggttcaagcgattctcctgcctcagcctccctagtaggtgagattacaggcatgtgccaccacgcccggcaaattttgtatttttagtagagatggggtttctccatgttggtcaggctggtctcgaactgccgacctcaggtgatccgtgcctggcttacttttttttttctttttctttttcttttctttctttctttttttttttttttttaagagatagggtcttgctatgttgcccagactggtctcaaacgcctggcctcaagtggtcctcccaccttggcctcccaaaacgttgagattacaggtgtgagtcaccacgcttggcgtgttttacatgttgacggacagcatataatcacatgtataagggtttctgcttgtaaaagtctggaaacccattctaactgccagaatcacaaaacctagagaaggggacataactgccctgtggccacccagtagcttttatcttctctcgcgacggcagaggcaggacagccagcattctggtgaggattgaaggattagttgtaagagatttcagcaggtctgcagtgatcagatgggtttctcacatattgttaagttgaaagtagccgtggctcagtatgagttgagtacctgtttaaaatctgcattcaaagccttcttcccagaggccacaactgcagtgagatccaagtgtgtggctcacccgccccggggctcacagctgggcagggtgatttccactcaaattcttgtgccagtgcagatcttgttctaaagcttttctaaatgcctggagactagaaagacttttggatacttttccctttttcttttggatgaaatttcatctccagtagaacagcagcattccatggtgcctcagccacgatcctctggagagagatttgcggcgaagacctgacgagagactgtaaaggaaaagcagggtttgtttttcctggtcaaagttgttaatactaaaaaaaaaagaagaaaaaaaaactttggccaggtgcagtggctcacgcctgtaatcccagcactttggaaggccaaggcaggtggatcacctgaggtcaggagttcgagaccagcctggccaacatggtgaagccccgtctctactaaatacaaaaaaaaaaaattagccgggcttggtggtgggtgcctgtaatcccagctacttggaaggctgaggcagaagaatcgcttgaacccaggaggcggaggttgcagtgagccgagatcacgccattgcactccagcctgggcaacaagaatgaaactctgtctcaaaaacaaaaacaaaaacaaaaaaaaccctttgatcattaaaaagttatatgactattttagaacatttgcaagtacagaaagaggtaaagaaagaatagcccaggtgcagtggctcacacctgtaatcccagcactttgggaggctgaggcgggtggatcacttgaggtcaggagtttgagaccaacctggccaatgtggcaaaaccacatctctactgaaaatacaaaaattagccaggcgtagtggtgcgtgcctgtaatcccaactacttgggaggctgcagcaggagaactgcttgaacccgggaggcggaggttgcagtgagccaaaattgcactgctgcactcctgcctggcgacagagcaagactccttctcaaaaataaaaaaaagaaaaaaaatcccataattctttgattccagtgacattttagtgttgttctttccagacttttaatttttaattaatttatttttatgagacagggtctctgtctgtcacccaggctggagtgcagtggtgcaatcatggttcactgctgcctcaacctccagggctcaagcaatcctcccacctcagcctcctgagtagctgatactacaggcacgcaccaccacaaatggctaatttttctagtttttgtaaagacaggcttttgctgtgttgcccacgctggtcttgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccccggagcagaaggctcacccctcctttggtgtttcagagcctctgggatattgggcacctgaagaactgcagccgcagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtgggtatcaaaggtggcgggcttggtgtgagtaggaacagtggctggtcatggaggggcttgtgtgccttgtcatcctctggagtctccagtaccctcctagggcctgggccatggcgcgccctccattggggaggctgcgtgccttcgtggaaagttttagctgaagtcctcgcctatatttcccaggctgttttgcagagttgtgagagttggttcatcgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcctgcccgcccgcccgagggcactccaggtctgatctttggggcgggttgtgggcttttgtcggaggaattggcagctccgtggcgggcctggcacccacagagctgccaattcctgtgttcggagttgttgcaggcctgactcacctgtgttctcatgctgtgtactcagggctgcccttgtggccgttcctccttgagactgaaagggtgggcaagtgctaggggtgaggggccaggagaggcagggaggccaagatgggttgactctctgctgtatgcctagtgctgtgtgggcaccttatacacacccgtctgtgttatcctcatgaaaaacacttaggatacatgttgataactgcattttcccaaagaaagcaagcttggcgagcttagatacttccatcaagatgatacaatagccaggcatggtggcgcgtgcctgtagtctcagctgggtgacagagggagacccctgtctctacaaaaaattaagagatcagttgagtatggtggcacatgcctgtagtcccagctgctcgggaggtggaggcaggaggatggctttagcccaggaggccatggggctgcagtgagtggtgattgcggccactgcactctagcctgggtgacagagtgagactcggactctaaataaataaataaatgaataaataaataaatgtcaccttttattaagtagtgtatgtgtgaccttgagttattcaaccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgagcatacacatcatattttatccccattttgccaatgaggaaactgagacccaggtagttacagtgacgtcctcatagtcgcgtggcttgtgataagatggggaccctggcttctggtgtggtcccagactgtactaccccagcaaggtttcagtgagaagggtaagaccaccttccctggaagggagacagatgtggagcagcacctggaaagaagcaggcctgggctctggcatcagtgtgcacacacactgcatcagctctgatttttttttttttttttttttttgtagaggtgggacctcttgtcactgaggctggagtgccttgggattatagctcactgcagcctctaactcctgggctcaagccatcctcctgcctcagcctcttgagtagctgggactattggcatgcacctccgcacctggctaacttttaaattttctgcagagatgggatctcactgtgttgcccaggctggcctcaaactcctgtgctcaaaccaccctcctgtcgcagcctccctaaacactggcattacaggtgtgagccaccacacccagtccccttgacctctttcagccttggtttcctgtccgtaagtgggagaaatgtcaccttggcagtctgtgcagcttaggagagacaagtacatttgatgttggttactaaatgttggaccctggaccggcactccaacagccggtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgagaccagcctggccaacatggtgaaaccccgactctactaaaaatacaaaaaattagctgggcgcagtggtgcatgcctgtagtcctagctactcgggaggctgaggcaggagaatcacttgaacctacgcgggaggtggaggttgcagtgagccgagatcacacgcctgggtgacaagagtgaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggtggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctaggagtttgagaccagcctgggcaacacagacatcatctctacaaaaagtaaaaaaatgagctgggtgtggtggtgaatgcctattgttccagctgctctggaggctgagttgtgaggattgcttgagaccaggagtttgaggctgctgtgagccaagatcacactgctgcactctagcctgggtgagagagtgagaccctgtaaccaaaaaaaaaaaaaaaaatcagctgtggaaaagcatcacgtgtttcccctgcgctgaggctgactctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggtaagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccgaccacagaggttgaagggttcctttggccggcaggccagcatggaggtggtgcgtcataggagttcagagggccctgtcccaccactcagtggctgtgtgccctgggcaggcaactgcgcccctctgcgtgtgtgcgtttctgctttttggtctgcgatgtgttttgatcttttttttttttttttttttttttttttgagacggagtctggctctgttgcccaggctggagtgcagtggtgcaatctcggctcactgcaacccctgcctcctgggttcaagtgattctcctgcctcagcctcccgagtagctgggattatagacatccgccaccacacctggctaatttttgtatttttagtagagacggggttttgccacgttggccaggctggtgtcgagctcctgacctcaggtgatctgcctgcctcggcctcccaaagtgctgggattacaagcatgagccaccgcacctggacctgcagtgtgttttgatcagtattattgagaatgaggcaccagtttcctctcggagccatcccttactctaatctggtggttgtcactgggggtgattttgtccccggggccatctgacaatgtttggagacactgttggttgttacagctgagtgggtgggaggtgggggtgctcctggcatctggtgggtggaggccagggatgctgctcgccatccggcagtgcactgggctggccctgcagtaaggaattattggcccacagtgtcaccagtgaggaaacttgagaaactggtttttccttttttttttcaattttaattttagttttattttaaaaagtatgggttttttttatcgtgtttgtttgtttgtttgtttgttttttgtaaagactgggtctccatcgccctgtgttgcccaggctggtcttcaactcctgagctcaagtgatcctcctgccttggcctccgaaagtgttgggattacaggcttgagccgtcatgcccagccctggaaactgtgtttccaggagtgtcgtagagtctgtgaaaactgtggctgtcagtcagctcccaagtcattgccttcacagtgtgtgaagtcaactgacaaagatagcagacaggataaataataacatggaaattgcatatcgtggcagagagcaggaagtgttaatcggggaatgaaagtggcaggtgttgtagaggtcgatttgaagttaggtgggtgtggtgtcatgtgcctgtagtcccagttatttaggaggctaaggcaggaggatcgcttgagcccaggaggtcagggtggcagtgaactatgatcacatcactgcactgcagcctgggtgacaaaggggtaccctgcctctaacaataaataaataaacaaatagcagcatgactgtgtacctactgtgttcctatttgtttattttggcggttgaaaaaagaatttgaacgttccctgtatcttggggatgctagcagactaacctttggttttcctttgaaaacaggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcaggtatcgtgggcaacggccgctcgttttgtctgccctgtgtttctgctcttagctgggaagactcaccccaattcctgcagatgcggctcctgccccctaggtggtcctgccgtggcatctcatttgcatgtggcatgtgggtgccgaggtgccgtggccgtccagagcctacctgaccccttgtacctgagtcctggcagtcaccacacgggttagaatctacagtcctttcactcacgatgattaagggcctccacatggagcagttaaaggcctgtggcctctgcttgcgggctgcatggcgagcattgtgcccgagaacactgggtcactgcctgtacactgactcccgccttgtgccaggccctaaggacccagagaccagagtatcagcccttacccctgagccctagtctagtgcaaggggctgtcagcgcggtgtgagggagggcagaatgtggagcacgtggcagtggctgcaggtggcacgggtgacctggcccccgtgatgatgcagcccagcccagagtgcctggtagagcgctcagctccttgagagagagagagaatgataccacgggcccagtgcagaccagagcgggtggcatttaaaatgaggagattggtcaggcacagaggctgacacctttaatcccagcactttgggaggccaaggcaggaagatcatttgaacccagcagtcagagaccagcctgagcaacatagcgagaccccatctccacaaaaaaaaatttttttaattagccaggcatagtggtacacacctgtaatcccagctacttgggagactgaggcaggaggattgctggagaccaggaggtcaaggcagcagtgagctgtgatcgcgccactgcgcttcagccccctaggtgacagagcgagaccctgtcttaaagctgggcccagtggctcacgcctgtagttccagcactttgggaggccgaggtgggcggatcacctgaggtcaggagttcaagaccagcctggccaacatggtgaaaccccatctctactaaaaatacaaaaattagccaggcatggtggccagcgcctgtaatcccagctacttggaaggctgaggcaaaagaatcccttgaacccaggaggtggaggttgcagtgagccaagatcgtgccactgcgttccagcctgggcaacaaagagcgaaactccatctcgggggaaaaaaataaaaaagataaaatgaggaacccccccaggatttccctggatttggccaaggtgaatgggctggccgtagccctctgactgtctgggtgacttggggcttcgtcattcattattgagaatgttgggcttggagcacattttgagaattcagagtggtagctgggacagggctttctgagagtgccctggtgcgggtggtgagggagtgggtgggcctggggccgccctggtcccagggaggaaatcatctcctttctccgcactggccctggtcggcatcctgctgcctccctgctcaccggcccacccctgcccaccgcagccacatcaagggctgaaacttcacagggtggttgagaccgccttggcagcttcttggacctctagtatttgttcagactgggtttccgaggaccctgccagcttgtgtaagacacagtgacagcgcctcccgctcattggttcgtgtcatgtgccaggccctcctgagcaggctgcttgagtgacttcactcatcccacgatgctctcaggctgagcagtgttcttcgcttacaggagagcacattcaggcccatgaggttggcgacacagccagcaagtagcggagctgggattcagcccagaccccaagagtgggctatctggggcacatggggagttattgacattcccgggaaggcagggggctcttttaatacattttaattttattttattactatttttaaagacaaggttttgctctgtcacccaggctagcgtacagtggtgcaatcatggttcactgcaggcttgaactcctgtgctcaagtgatcctcctgcctcagcctcctgagtagctgggaccacaggtatacaccaccacacccggctaatttttcagttttacgtagaggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttccggggcatcttctgccaggagttggggcacgtgcatctgagatctttctgggagttgggagtataggaaggtgtcatcggggctctctgaggacatagacataggcaagccaggctcagggagatgctcccccaacttccctccctgagtatctgggtcagcctgtttcagagaacagtgtgctctatctgctggcccaggagggttcttagaggtgctgggacttctgtcagccctgttccactcagcttcctggagcttcttaagttcttaggaattattttgaggcaaatttctagatagtgctagagctgggattctggagttaagtcatttaatgtggatttgttcctttctcctggtattgggcctcgttggtctttcctaaaccatttccgtttctcccagtatttctctggggtccccgtccctggcctgagggcccccagaagtgctgatgtgggtcctaccggtgtgggccaggcaagttacagaaaagaaggtggatgggccagtctgtcttcccttggtgctggggtgggcatgctgtggcttgccccacgttgtaagtcaggagggaaccaggccagcaggctctgttagtggaaacagcctcaaaggggcctgcctcctggggtaggtgtaggtgcatcctgattcctttggttttcttggagctgggagaggtgtaattcacctgcacgagcctatctacgcgctgaaaaacaggcttttcccctgcctgatttgtagtgaggccccctgcagttaaccctcctctgacggatgtagagccagatggggcttagtaaatacctgacctcttaacctagcaggcggcaaggttctcacagccaagtgcatgtcaacagcatcaggtgaaagttaccttggatgtgaggaggcaggcagggcaggcagggcccgtctagagccagcgccatgggctggggaagcccgagaaccgactttttactggcagccactggaaataccatgtgagcgcgtgaaattgaaaaatttcctggaactcacgtgcacagcttccacgtgccccctgggaacaggccgtgatacaagaaagcgtgtcatctggggctgagctgctgggtggcagtagatttcctggtagctgaagttgatccctttaagcaccaaaacttgtgttttaatgatgttggatggaaatctttcctaaatgtgtcatgcatgctcttgtctcccttaatggagagagtgtgacactgcttagcacttggatggcttggggtggtggttatgaccagcagtctgtcacagctcagcgaggtgaagcctgtgggcgttttgctctgtgctgaatggctcagtggccctgcaaaacggcgctcagctcttggtggctttctgttgtggtgggctgctgctgctgctgctgctgctgctgcccttgcctctaaaagaactcacttcctcttcctcctgctgccacctgtcttttggcttgtgggattggagtcatggggcccagatggagccttgctcctgacttatgataggccctcggtctcttttcttctctatttttttcttctttcttttctttttctttgttttttgttttgttttgttttaagagacagggtctcactctgtcacccaggctagagtgaagtggtgtgatcgtggctcactgcagcctcaaactcctgggctcaagggatcctcctgcctcagcctcctgagtggccaggactacaggcttgtgccattgtgcccagctaattttttaaattttttgtagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcaccactgccctggcggcctttgggaatcatcctcacaggtagaggaattgaggctcgggaaggggacttgccatgctcagcacacacggctttgagcgggagcatacgcctctagcatcgtctccagcctctgcagctcatgggactggctgccagccccaatcccagagggtgtggacttggagaggggctttggatctccttcctctccggcctcctggctttgcccctcgccctgcatagaaaactcggagtcctcatgtctcacgtttcccactctgtctgggatctcctggagatggtcacagacaggaaagccagggagggcctaataggtggaccaggagttggggagaggaggagggtgcctgaggccatgactatagggacttctcagagaaggacacttcaggaggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctccattcacagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatacaaaaattagccaggcgtggtggcgggcacctgtaatcccagctactcgggaggctgaggcaggagaattgcttgagcctgggaggcagagaggttgcagcgagccgagatcacgccactgcgctccagcctggatgacagagtgagactccgagaaaaaaaaaaaaagtggggggaagagttgaaaccagctgaggaaggggaggagcttgctccaaatgaatgaaactgagtgttcagtagagtcaggaccttgacccaggtgtccagactccctgcccttcttagcattatcagggcccccagatccactaccagccttgcctttggatcgggagtaggcaaggagagcaagaagctgctctttgcttagcacggccacagaggcaatcctgtttgagaacagtcaacaaacaaactcaaacaggccatgcacagtggctcatgcccataatcccagtgctttcagaggccaaggtgggaggatctcttgaggccaggagtttcagaccagcctggacaacatagcaagattctgtctctctctctatatatataaaattagccaggtgtggtggtgctcacttgtagtcccagctactcaggagggtgaggcaggaggatcacttgaacctgggaggtggaggctgcagtgagctatgatcgcaccattgccctccagcctgggtaacagagcaagaccccaactctgggcccagcatgcttccagtgtgtcactctaccggcatgaccctacctcttaaaaaaaagaaatatgatgacttaagaccaaatgagtggccaggtatggtgtctcatgcctgtaatcccagcactttgggaggctgaggtgggcagatcacctgaggtcaggagtttgaaatcagcctggccaacacggtgaaacccctgtctctactaaaaatacaaaaattagcagggtgtggtggctcatgcctgtaatcccagctacttgagaggctgaggcacgagaattgcttgaacccaggaggcagatgttgcagcgagccaagatcatgccactgcactccagcctgggccacagaacgagactctgtctcaaaaaatccaaagaccaaatgagtgacttgaacataatcattgtagggaacacaaccctcatattaaaaaaaaaaacaacaacaacctttattttatggtaattaagttccggaaaagttaacaaaagtagttgggtttccatatctccctcatctggcttctgacattaacagctttcataaccatggttcagttgtcagatccagaaaattaccactggttggctgggcacggtggctcactcctgcaatcccagcactttgggaggccaaggcaggcggattacgaagtcgagagatcaagaccatcctgggcaacgtagcgaaaccccgtctctactaaaaatacataaattagccgggtgtggtggcacgcacctgtagtcccagctactcaggaggctgaggcaggagaatcgcttgaacctgggaggcagaggtttcagtgagccaagatcacaccactgcactccagcctggtaatagagcgagactccgtcccctcacccccgcaaaaaaagaaaattaccactggtataatactcttaactaaaggttttttttttctttcttgatttttcaccaatttcccactactgtcctctttctgtcccaggatccaatccagggtcccactttgcttccagttcttattctccccgtcctcctctgggctggaacagtttgtcagtctttatctttcataaccttgttactttcaaagaggtgctttgttgaatgtcccttaatttgagtttgtcttgttttcccatgtttggacaaagataatgccctttgttatttcttttttgacagagtctccagcctgggctggagtacagtggtgagatcatagctcactgcagccttgaactcccaggctcaagtgatcctcctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgatcatttgctaaagtggtgtctgccaggatttttctcctctaaacaggtgctatgagaacctgctttttttttttttttttttttttttttttttttgagactgagtttctctctgttgcccaggctggagtgcagtggtgcgatctcggctcactgcaacctctgctgcccgaggttcaagtgattctcctgcctcagcctcccaagtagctgggattacaggcgcctgccaccatgcctggctaatttttgtagttttagtagagacaggattttgccatcttggccaggctcgtgttgaactcctgacctcgcgatccacccaccttggcctcccaaagtgctgagattataggcgtgagccactgcacccagccattttttttttttttttttgagatggagtcttgctctgttgtccaggctggagtgcagtggcacggtctcagcaacctccacctcctgggttcaagtgattctcctgcctcagcctactgaatagctgggactacagctgtgtgccagcatgcccagctaattttttatatttttagtagagatggggtttcaccgtgttaggatggtatcaatctcctgaccttgtgatccacctgcctcagcctcccaaagtgctgggatttcaggcgtgagccaccacgcctggcctgagagcctgcattttgatgacactagtgagtgtaaaatatctttttttttctttttattttctttattcacaacaggtatgaaatgattgttttcagagtcttttttttttttttgagacagggtctcactctgtcgcccaggctggactgcagtgatgtggtcatggctcactgcagcctcaacctcctgggttcaagccatcctcctgcttcagcctcccaagtacaggtgcgcaccaccacacttggcagacttttaaaaatttttttggagatggagtctcactatgttgcccaggctggtctcaaactcctggcctcaagtgatcctcccacctcatcctcccaaagtgctgggattactggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccagggagcgtccctgccactgtgcccatgcagatgccaaagcccagcagagtccagcaggcgctcgcaggtaggtgcctgccctcgggctgcagagcagtctgtgccctgcgggacttggtggggaggaaattgtgatgtggggccttgtcaccctctggatcctcagggagagccagaggggctccctgggggagcagtgcctctttctggtgatggtgtcaccccagagtgagcccaggtgcccctccttttgctctctgggtacgtgggcctgatgacggtgggcgctcgggtgcagaccttttcacatcctttaacatttttgcattgaattgcattatatttaaatagtcactttcctgtcctgaaatactttaaacatttccttaaaggggccctctggggaattaatagatctatttcggctgtagttactcttacatcttgaataagaggcaccttttgggtccaaccagatcttttgctgtactaaccatacatcttacatcttggaactgttttgggtttggtttggttttttgtgagacaagagtctcgctctgtcacccaggctggagtgcagtggcgctaacccagctcactgaagtcttgaactcctgggctcaagcaatcctttcaccttaaggatccttaaaaatacctactgctggcccccacacccattctgttttagcagcctggctagcagggttttcagaagctccacaggtggcaggattttttttcttttttctttttttgagatggagtctctctcgcccaggctggagtgcagtggtgggatctcggctcactgcaacctctgcctcccaggttcaagcaattctcctgcctcagcctcccgagtagctgggattacaggtgcatgccaccacgcccgggcaatttttgtatttttagtagagatggggtttcgccatgttgaccagtctggtcttgaactcctgacctcaagtgatccatccgcctcggcctcccaaagtgctgggattacaggcatgagccaccgtgcctggccattttttttttcttgttataagtgacaggatcttgctctgttccccaggctggtgtgcagtggtgtagtcatagctcactgcagcctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctgccacgcccagctgaggttattttctaacttctggaaagttcgaggtatgtaaggaggtggatggcgccatcgttgttcacagggtgatgtggcggaattcaataatgagttggtgttttaggggagttgctgtcgtagtggctgagaggggacaggcctggaggtagggcggctggtgcagagcctgacctcagacctgggggcaccagccaaggcctgaccagcttcgaggcagtggagttgagggggaggtttggcttgaaacattcagaggcatgagccgtcaggcggggggttgtgaggggggattgggggtagactgaggcctgctggagtgcagccagtgacaactgaggagcagcctggggcttggcgtgtgtgaattcatttcgtccttaaatcactgaggtggaggcttttgttcccattttcattagaggaaactgaggctcggagaatttaaaaattctctgccagcccttggcagagctgagacacagccccgggccttcttgcctatgacggttcagtgctgctgagtctagggggaggttgggagggggtgatggctgtggagtggccgttggagctgttccggggcagtgggatttggctgtgggcctcagaagagcagtcttgggtggaatggggtgcccctgacccctcgtgggagcgtgtgtgccacagagaccgtgggcgggactgaagagaaaatgaaggagcggccagagaggtgggggcaggagggagaggagctggagcggggcaggggagacagaatgagcaagacacactggccagaaagtccctgctcactgaagtcaccgtgcggcgccgtagggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctgagtgccctgggtgtggagttagcacctgcccccttcctctgctcttgaggctgaaggtcctgtccaggctgtgtcccaaattgtccatcctgttgtctgtccccgttgctctcagagcaatcctggagctaaagcaggtattttaacatccattttacttgtggggaaatagattcgggaagctggttcaggcctaaggaaataggagagcctggaggctgtgtggactcctgcctcccccaattcaaggcccagtgttggtacctactgggggagcattgtctaggggagcagggaatgagaggagcctggccagcaccccggagccagagctggagagcagtgtcctgtcaccctggtgtgcttgtgggttgaggaattataccatgcccggctgcggagatgagcgtttgcgcacagggtttttgcagggaggtttataaccaggaggtcatgctttggaaggactgagtgctggaggcactgcttccaagtgacagtgcctccaggtgacagctcccctggctgtggcatagcccagtccctctatcgggtgggggcagggactgtgaggctggagccagggtctccacccctcacctggtcacagcagcggtccatccacagctcacactgctgcctggggcagggatgggtgtcagcagcctgcccaggactgctcagctggtgagggctggcactgggctcgaacccaggctggggaggtcagagcgcacagaggagaggcttggatctcagccctggccctgggtgtcagaaggaggggtgtctgcaaattggaagtgagaatcagtgagtgggggcttcactcttcagggctctgacagcgggaatcctcccagatgggtggagaaaaaggctgtggccctccgagttattcaggtgatttgggggctgtcaggagtttggggggttgtccctagccctcctcctctccaggcttctgggttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagtacggcggggcgggaggcttggagggacaggccccgtcaggcagtgttcagggaaggcctgcccgccgaggcagtgttgccggagaaccctgggtagggagacgtgtcctggcctttggtcctcccagacgacgtgggcagcgcagaggcaccaggttctcttgaggaaaattgcacctgtccctgtcctctcccatctgtctgccacccgcgcccgcttgtccttctctccacccgacattcagttcccacaggaaccgcatttgagcccaggaacaagcttgggatgttgggggcattgagctcccgggctcaaacctctgtcctctgatgcacgctttggtgtctcctgctgagcggccactgcaactcaccctgcccacctcggctctgctgcccaggctggtggctggtctccgcttctgtccccacagccaggcacatgtgccgggttgagaagctttgttcttctagtgggggcgcagtggctggcctggccgcccttcacccctgagtcacgccatctgttcctggatggggagtggggtccaggaggactgggatctctaccaactcccccggcagccggctgtgcccagctcctgagccaggttctgcagaccctggaagccaccttaagggatggctaagaagctctgggcttcccctttctctggagaggaggtgcttttgacctaactgaccgatgacagggaggaccggggagctggcactatggaaagtggggtaggccgagggtgtggcaggaacgggttcgtccagcaggacacgctgtgtcccaggaagcgctgggtcatcagggagcacgaaggaagcagtgtcagaggagagtcccccagggcaagtgtggggttccctgcaggcatccggcagtggtgagctctggaaagagtggccggtctgtcccagcatagctgctggccacaggcccacccttgcccgagggcgccagagccacagcctggggccttgctgcagcccagccctcacagtatggggatgctgcagtgtgggagcaggcccaggggccacgttcctgcccgcctaccccagcgctgtcgctgaaggccctggcacccagatcagccaggaggggcatggagcacacacagcgcccagtggaggctggaggcctagtaactccaagccaggagggcccagggcctcctggggaagctgagcccttggagccagccccacccaggagaccccgtgccccgggcggcttcctggagtggcgtcctccgccctctgctctcctgaagtcacgggtcctgccccggtgcccacctgcacactgagggcacgggcttgtctgttgctcctatagaaacctgtgggctctggggccagggctaccatgagccaggctgccccaccctctgattcctggcctgggtagtccccagggagacctgtgcgtccccgtggccattgatggtgtcacatccttggcctgagcagggtttgttggcgtcacatgccgaaggagtcttctaatgtctctccctctctgcgtgtctgctctcacgcccgtgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggtagttcttgttcccaaaagctctctggcctttgctaagcctccttccggcctcgctgcctccgactcttctgcacagaccctcttccttctctctgctccctgactcctgggggaaggggctcagtggcccttctccctgcccccgctcggcagcagaggcggcccctggaagctgactttccaccgcagccccagagttcagctcctctcctccagtcacagctggcatgagggggcttgttcttgaggactttgtgatttttgtaagcagcaagttgtgggtgagaggcggcgcccggctcaggatgcggggacaaccgtcccttccgccagggccagcacgtgtctcgggaaaggcccccagacagcggcccaggtctgctgcccaggtctgctgccctgacccccagccctgtgtggccgccacgtgggctgcttgagaggggtccctcggtgacccctgccctgctcgttgcatggccacagaagaaggggctttaggaccacagcaggtccagggagttacagcaagacctgctcggagcagcctgtgatggtcaagttctgaacctttcccaagcgggtgctggccctgcttccacccctgggctgtggaagtgtggactgtggccagtccagatgctcttgagtgggcgtggtggcgggcagggagggtggccgtggccctgctggccctcagtgtctgtgtcatctcagcaggtcctctcggagcctccgcttagcagaggggcttggcgaggtctaggaaatactcgaagcgcctggcatgcggcaagggtggcttccgatcgtgtccgacctccagcccacaggcgaggaggtgggctcagggaggggtgggcctcgagctcctgcccccagcccagggctctgcacgccctgcccttcccctgccctgggggaggagccagactcgttggcagcccggctggcaaccttctgtggcactcgggtttacctgggaaggacacgctcttggtgggtcgcctggctggccccttctgagacacgtggctaatggaaagctcccttctgttctgaaaagctgcaagggctggggtgggtgggcgggggtgggatgctgtgcccggcctcaccagggctgggcagaggcgaggcccaggctcacccggagatggctctggagttggcaggcttttccaaaggaaaaggcccccctcagcctgagtagggcattccagccacacggagggtgaccctgagctgggggccatcgttctggtctggcgttctcgccaccgtgacaggatttgggttcgggcagtctgtatgggtgtgtggaggtgtgggggtgtgtgaggtgtgtggaggtgggtgtgtggggtgtgtagaggtgagggtgtgtggggtgtgtggaggtgagggtgtgtggggtgtgtggaggtgtggggtgtatggaggtgtggagtgtgtgtggaggtgtgtggaggtgtggggtgtatggaggtgggtgtgtggggtgtatggaggtgtgaggtgtgtggaggggtgaggtgtgtagggtgtgtagaagtgtgtggggtgtgaggtggggtgtgaggtgtgtggaggtgggtgtgtggagctgtgtgtggtgtgtggaggtgtgaggtgtgtggaggtgtggggtgtgtggagctgtgtggggtgtatggaggtgtagggtgtgaggaggtgtggaggtgtgtggtgtgtggaggtgtggggtgtgtggaggtgtggggtgtgtggagctgtgtggggtgtatggaggtgtaggctgtgaggaggtgtggggtgtgtgaaggtgtggggtgtgtggaggtgtggggtgtgtggaggtgtgggatgtgtggggtgtgtggaggtgggtgtgtggggtgtggagatgtgtgaggtgtggaggtgtgtggtgtgtggaggtgtggagtgtggggtctgtgaaggtgtgaggggtgtgtggaggtgtgggagttgtgtggcgatgtgtgtggggtgtgtgtgtggaggttggtgtgtggaggtgtgtggtatgtggaggtggggatgtggggtgtgtagaggtgagggtgtgtggggtgtgtggaggtgcgtggggtgtgtggggggtgtggaggtatgcggtgtgtggaggtgggtggtggtgtgtggggtgtctggaggtgtgtggggtgtgtggtgtgtggaggtgtggggtgtgtgtggtgtgtgtggacgtgtggtgtgtgtgtggagatgtgtggtgtgtggaggtgtggggtgtgtacaggtgtggggtatgtggagatggggtgtgcaggtgtgtggaagtgtgcaggtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtggggtatgtggagatggtgtgtggaagtgtgtggtgtgtgcaggtgtgggggtgtggaggtgtggggtgtgtggaggtgtggagtgtggggtgtgtggagttgtgaggtgtgggtggagttggtgtgtggtgtgggatgtgtggaggtgggtgtgtggaggtgtgtgggatgtggaggtgtggggtgtttggaggtgtgtgggatgaggtgtggggtgtgtggaggtgtgggatatgcggggatgtgtgggaggtgtgggtggagttggctgtgcgtgggggggtgtgggtgtggattggggtgtgtggtgtgtgtataggtgtggtgtctttaggtgcggggggtgtggattggggtgtggtgtgtgtaggtgtgtctgtaggtgggggtgtgggtgttggtgtgtgtgtggaggtgtggggtatgtgggggtgtgtggaggtgggggtgtgggtgttgtgtggggtgtgtgtggggtgtgtggaggtgtggggtatgcggggatgtgtggaggtgtggggttgtgggtggagttgggtgtgtgggtgtggaatggagtgtgtggtgtgtgtataggtgtggtgtctttaggtgtggggggtgtggattggggtgtggtgtgtgtgtaggtgtgtctgtaggtgggggtgtgggtgttggtgtgtgtgtggaggtgggtatgtgggggtgtgtggaggtgagggtgtgggtgttgtgtggggtgtgtgtggggtgtgtggaggtgggtatgggggtgtgtggaggtgtgggggtgtgggtggagttgtgtggggtgtgtggaggtgtggggtatgtgggggtgtaggtggagttgggtgtgtgtgggggggtgtgggtgtggattggggtgtgtggtgtgtgtgtaggtgtggtgtctaggtgtgggggctgtgggtgtggattggggtgtgtgtgtgtaggtgtgtctgtaggtgtggggggtgtgggtggaggtgtggggtgtgtggatgggggttggggggtgtggtcttgccagcagtttccctccaggtcacagcagccatgccatcacagcaattccagcttggttacatattcgtctttcccgtttgagatcagggaaccgaggctcagaggtggcatgattcgttcacagcaagagaactagaattaaacaaactgtgccgactccagcctccgccccaccacgccacctccctgccaaactgtcccctccctggccctttttggtgtaaagggagttcagcaggtgcagctgtgcgccctcaggcttagaggcttagaattctctgcagcacctaaaggccgtgagcttggattcaaaccagagccccttctggtcctggagtctgggacgaccgcagccccaccatgaccttggggtggagcccctgtcaggagcgcctccacgggtggcactgggctccccgtccctctttcacccccgcacgggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaacaactccacatggaaaggacatccgccccatcttgcttgaagggtgcttcccaggtgcctctgggtgccagggccttgctccagcccctttggtttcatctcccagcctcccgagacccacatcgttatgatctgagctttgcacttaaggagctgtggtcctgagcaaagcccctcctctcccggccctggcctctccatagcctgatggccatcctgggagcaggaattccagagacaagggatgggccagcctgccccactctccaccttgcggatgctggtgtagaagtgaggtggcctcgtccaggtggctgtcctgtcccccggctattgggagagctggtcaaggttcttataatttttttattcttaaagacgggtgcacactgtcacccaggctcagtgcagtggcgtgatcacagctcactgcagccctgtcctcctgacctcctgtaatgaacaggaccaatcagactcctattgcgcttccatagaacctgaacctctgctgagccacgttttgggggctgcagcaccactttcccctgattttagctgggagcccgggagatactgttgggggagggggtgggcgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcgtcctcatgtgtcccaccccttccacaagcccttgccacattcccgcctgcccagcgctcagctctgtctcggccctggtgtccatctggtgtgactgggccgtttcaccccaggctcctcctctccaagctgccgtctgcacagccagcacgcagcttggatcatgggagcactccctgcctggaacccccagcaggacccccaactcacacacaaccccaagcccctgagtgtggcagccagacccccgagggcgcgcctctccctgatcctgtctcatctcctgctcccagcccaccccctgccagctttagtgcccatgcgctggctcctcgttcagaacgtcctcctccctcttccgggtgcccactctgtgcttgtccatctggcaattcctgtctcccttgtaagaccccactccgagggcctcccccaggatcctgccctgtccgtccttcccatttggtggcttctgctgtcatgtcgggcctgtgctgctggtaagcccttcaagggcacaggtcccggtgactcacctgtgtctccagcctgtggaatggactttttttttttttttctgagacggagtctcgctctgtcgcccaggctggagtgcagtggcataatctcagctctgcaacctctgccccctgagttcaagtgattctcttgcctcagcctcccgagtagctgggattataggcgcctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctcttttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaactgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcaccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatggcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattcccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctttccatggcccgtgtcaatgccggtatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgtattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcacctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctgtacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccttgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcaagcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttggtgctcaggggcaccaccaggagaggcctccggctgaggtcagcttcccagagaggaaggtaagggactgtccctagctcaggactggcacccaccctgcagagagccacgccttcctcaggagggctctgctggacagagacctgatcaagggcgtctcccactccttcaggatggagacaaaagcccaactggtggccgagagtggtggcttatgcctggaatcccagcacactgggaggccaaagcaggaggatcacttgaggccaggagtttgagacgggcctgggcaacatagcaagaccctcgtctctattaaaaatataagaaatatgccagacgcggtggctcatgcctgtaatcccagcactttagaatgctgaagcaggtggatcgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtctcaaaaaaataaaagaaattgaatacattgatattttgccaggaccctgccttctacaggcatctagtctaatgggactggcagtaaccaaggcagatgagctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaagaagcagtgaagccgagccaggaaataccaagatggcgagccagtgtgcttgtagagattgtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcgagtgatgcgagggggacctgaactgtggcctctgtcatgggaacccagaggaggtcgatggcgtttgtggttgatgtgggaaggagagagagagagaagaaccagaaacgtctgcttgctggaggaagcggcatgtccgctcctccactccttttcttttccccttaggagcggtttatggttccttttgttttattcttttatttgtacactggcattggagtttgtttttttggcttttttttttttttttgagaaaaagtctcactctgtcacccaggctggagtgcagtggctcgaccttaacttactgcaacctccacctcctgggttcaaagggttctcttgcctcagcctcccaagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatctgagaagccagaggaagggttttgggtgatgctcccaggatggtgggctccgatgggatctttggagggggtgtgtctaggtcggctggtgtcaggagggtcttttgtgtgccaggcagagaactgtcccaaggagctgagagtagaggggccaggagcttcagggctgcagccagactgtggcccagggctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttcttgatttttatttttatttatttattaatttattttgagacagagtcttgctctgtgggccaggctggaatgcagtggcctgatcttggctcgctgcaacctctgcctcctgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctttttttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacacccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttctttttttttttttttttttttttgagacagcgtctcactctctcacccagaatggaatgcagtggcgctatcttggctcaaagcaacctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtccttccctggtctctggctctctgagtccctccttttttgttttgttttgttttgacacagaatcttggtttgtcacccaggctggagtgtagtggtgcaatctcagctcactgccacatccatctcctggattccatttattcttctgcctcagcctctcaggtagctgggattacaggtgcctgccataatgcccagctcaattttgtacttttagtagagacagggtttcaccatgttggccaggctggtctcaaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccagtctcaagtgattctcctgtctcagcctcctgagtagctgggattacaggtgtgcaccactaccacttgactactttttatacttttagtagagatggggtttcaccatattggccaggctggccttgaactcctgacctcaggtgattcgcccgcctcggcctcccaaagtgctggggttacaggcgtgagccaccgcacccggcccccttccttcgtcttagtcaaccctatcccacctcttcttccaccagtcccctcacctgatggtcccaacacttcatcatccaccacctcctggagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaatttttttttgataaaaaataaaagagttacatgacattcagagaccatccaaaaaacctgtgggttcccggctgggctcagtggctcatgcctgtaatcccagcactttgggaggccacagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctggtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttggtgacctggggctgggtgggcctctgagagcctttatagctgattgccttttgggagagggcaggtgggagccccaccctgtctcatgagtcaccccaaaggtgcatgggcaggcaggtgctggggaatcggctactccccagagcttggcgtggccatccctctggcccctctgggagtctggagcccattccctcacactggtactcactgcagctggggacatctgcactaggaagacaggacacggcatggaagctggcctctgcccagaagccatgacattctggtcaccagcctgatgttataaaacgagtgtcatggccgggcatggtggctcacacctgtaatcccagcactttaggaggccaaggcgggtggatcatgaggtctggagttcgagaccagccgggccaacatagtgaaatcccgtctctactaaaaataagaacattagccaggtgtggtggcacatacctgtagtcccagctcctctggaggctgaggcaggagaatcacttaaacccaggaggcagagattgcagtgagccgagacgacggcattggactccaggctgggcaacagagcatgactccgtctcaaaaacaaacaaacaaaaaaaacgagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagatcagcctgggcaacatagcgagcaccccatctccagaaaaaatttaaaaattggctgggcgcagtggctcatgcctgtgatcccagcactttgggaggccgagggggatggatcatttgaggtcaggagtttgagaccagcctggccaacatggtgaaaccccgtctctactaaaaatacaaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaacctcccccaaccaccctcagctcaagcaattctcatgcctcaaccctcagcctcatgagtaactgggactacaggcgtgcaccaccatgcccagctaatttttgtatttttagtagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctggatagccccctacccacatgcctcagcattgggaggtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtcgactaatgacccttgtccctcccctcagctgcctctcttttttctttttttttgcttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcgaactcccgacctcaggtgatccgcccgcctcagcctcccaaagtgctgggattacaggcatgagtcagcgcacgcagcccatcttaagctttttttttttttttttttttgacgaggtctctctctgtcattcaggctggagtacagtggtgccatctcagctcactgcaacctccacctcccaggttcaagcgattctccccgcctcagcctcctgaatagctaggactacaggcgtgcaccaccacgcccagctaatttttatatttttagtagagacagagttttaccacgttggccaggctggtctcaaactcctgacctcaggcgatccatgcacctcggcctcccaaagtgctgggattccaggcttgagccaccgcccctggcccatcttcactatttttaagtggacagcacagtagtattaactatatgcacatcgttgtgcaatagatctctggaactttttcaccttgcaatactgaaaccctacactcaacaaacaactcgctttccctgccccgctccagcccctgaaaacttctactctcctttctgcttctgtgaattgtactattccagatacctcccataggttgaagcaaccactatttgtctttctttgtaactggctcatttcacttagcattatgtcttcaggtttcatccatcttttagcatgtgtaagaatttccttccttgctttgtttgtttgtttgtttgtttgttgagactgagtttcactcttgtcacccaggcttagagtgcaatggtgcgaacttggctcactgcaacctctgcctcccgggttctcttgcctcagcctccagagtagctgggattacaggcgcctgccaccatgcccggctaatttttgtatttttagtagatatggggtttcaccatgttggccaggctggtctcgaactcctgaccgcaggtgatccacccacctcggcctcccaaagtgctgggattacaggtgtgagccaccacgcctggccttgtttttgtttttgtttttggagacagagttttgctctgtcgcccacgctggagtgcagtggtccgatcatacctcactgcagcctcccctcctaggctcaagcaatcttcctgcctcggctttctgagtagctcaaactacagacacacactggtcatgaaatccttgcctaagccaatgtctagaagggtttttctaatgttatcttctagaatttgtacagtttcaggtcttagatttaagtctttaatccatcttgagttgatttttgtataaggtgagagatgaggatccagtttcattctcttacatgtggctagccagttatcccagcactatttgttgaaaagggtgtcctttccccactttatgtttttgtttgctttctcgaagatcagttggctgtgtttgggtttatttctgggttctctattctgttccattggtctatgcgcctattattataccagtaccatgctgttttggtgatgatggccttaaagtatagtttgaagtcaggtaatatgatgcctccacatttgttctttttgcttagtcttgctttggctatgggactcttttttggttccatatgaattttagaattgttttctctaactctgtgaagaatgatggtggttttttgatggggattgtgttgaatttgtagattgcttttggcagtatggtcattttcacaatattgattctacccatccatgagcatgggatgtgtttccatttgtttgtgtcatctatgatttgtttcagcagtgttttgtagttttcctcatagaggtctttcacctccttggctaggtatattcctaagtacttcatttttttttgcagctattgtaaaaggggttgagttcttgatttgattctctgcttggttgctgttggtgtttagaagagctactgatttgtgtacattaattttgtatctggaaactttgctaatccttttatcagttctaggagctttctataggagtctttagggtttttgaggtaaacaatcacatcatcagcaaacagtgacagtatgacttcctctttaccaatttggataccctttatttccttctcttgtctgactgctctggctaggactttcagtactgtgttgaagaggagtggtgagagagggcatccttgtcttgtttcatttctcagagggaatgctttcaacttttccccattcagtattatgttagctgtgggtttgtcatagatggcttttattacattgaggtatgtcccttgtatgccgattttgctgagagttttaaccataaagagatgctggattttgtctaatgctttttctgcatctattgagatgatcatgtgatttttgtttttaattctgtttatgtggtgtatcacatttattgacttgcatatgttaaaccatccctccatccctggtatgaaacccacttgatcatggtggattgtctttttgatatgttgttggattcggttagctagtattttgttaagaattttagcatctgtgttcatcagggatatcagcctgtagttttcttttttagttgtatcctttcctggttttggtattagggtgatgctggcttcatagaatgaattagggagggttccttctttctctgtcttgtggaatagtgtcaataggattggtaccaattcttctttgaatgtctggtagaattctgctatgaatcagtctggtcctggacttttttggttggtaatttttaattaccacttcaatctcctgcttgttattgatctgttcagggtatctaattcttcctgatttaagctaggaagtttgtatctttccaggaatttatccatctcttctaggttttctagtttatatgcgtaaaggtgttcatagtagccttgaatgatcttttgtatttctgcccccattttgtttcttattgaggttatttgaattttctctctttttttcttggttaatcttactaatggtctatcaattttatttatcttttcaaggaaccagcgttttgtttttatcttctgaatttttttgtttgtttcaatttcatttagttcttctctgatcttggttatttcctttcttctactgggtttgggtttggtttgttcttgtttctctagttccttgacgtgtgaccttagaatgtcagtttgtgctctttcagtctttttgatgtatgcatttagggctgtgaactttcctcttaggaggaaaggtggcctttgctgtatcccagaagttttgataggctgtgtcactattgtccttcagttcaaagaattttcaaatttccatctggattttgtttttgacccagtgatcattcaggtgcacattatttaatttccatgtatttgcatggttttgaaggttccttttggagttgatttccagttttattccactgtggtctgagagagtgcttgatataatttcaactttcttaaatttattgaggctcattttgtggcctatcgtatggtctatcttggagaaagttccatgtgctgttgaatagaatgtatcctgcagttgttggatggaatgttctgtatatatctgttaagtccatttgttccaagatatagtttaaatccattttttcttcattgactttcagtcttgatgacctgtccagtgctgtcagtggagtaatgaagtccttcactattattgtgttgctgtctgtctcatttcttaggtctattagtaactgttttataaatttgggagctccagtggtaggtgcataaatgtttgggattgtgatattttcctgttggacaaggtcttttagcattatataatgtccttctttgtctttttcttcttcttcttttttttttttttttttgagacgtagtctccctctgtggcccaggctggagtgcagtggcgtgatctcagctcactgcaacctctgcttcccgggttcaagcaattctgcctcagcctcccgagtagctgggattacaggtgcccaccaccacgcctggctaatttttatatttttagtagagacagggtttcaccatattggccagggtggtcttgaactcttgacctcaggcaatctacccgcatcggcctcccaaagtgctgggattacaggcatgagccactgcacctggcccttctagtcttttttaactgctgttgctttcaagttagtttttctgatataatagctactcctgctcgcctttggtgtccacttgcatgaaatgcctttttacacccctttaccttaagtttatgtgagtccttatgtgttaggtgagtctcttcaagcagcagatagttggttggtgaattcttatccattctgcagttcttatcttttaagtggagcatttaggccatttacattcgatgttagtattgagatatgaggtagcattccatttgtcattttatttgttgcctgtgtactttggttttttgtttttgttttttaaattgtatttttgttttataggtcctgtgagatttatgtcttaaagaggttctgttttgatgtgtttccaggatttaagatttagagctccttttagcagttcttgtagtggtggcttggtagtggtgaattctctcagcaattttttgtctgaaaaagactgtatctttcatacacaatgcctagtttcgctggatacaaaattctcggctgataattgttttgtttgagaaggctgaagatgggccccaatcccttctagcttctagggtttctgctgaaaatctgctgttaatctgataggttttcctttatcagttacctggtgcttttgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgatttattcctatggttgttctggagctaaaatgcatgacacgagcctctacacgctgctctgtccgtccgagtcagagccgcaatctagtcttttaaagggctctctccacctttaaaaacccttacctataagccatctgagagttcaagtgttaagtataatctgcctgattctccttgcttggtccctacaaacaaaggctttcccttctcttgctacaagccttggtttagatatggtatagatacatagtcttattacgctgggcgagtggacctccgtttggttcaataacaaaatctgaactgaggagagttgtgattacactattgcatttcatcataaatattttccttgttgaatccaagcacacaaagtacagaatgatcctcttcctcagtacagtttttccctctgttatactagtaccatgatatcctcagctgaagaaaaggtgctagatgctctgtaccatctgatctttttgtcaggtgcttttctgatgcaaattattctctgaattcttatctctccctttcactctgagccataatcttgtctatgtcctggagctcattgcgtttttcccagaacacagttgagtattcaaggacctcccgtaagctttttccctcttcttctcttgctatattttcaatatcacaaccccattttaattagctttgataagctggttaaaatctctgagttcaattggtaaatccctgtgttaactctatctcttcatcaataaggggttcagcttatttaaactgttctttttctgtgcctatgctgcatttggtaggtcgtgattttgaggtaccttgtacccagttgcttttctgtaatacagagtttctttttctagtaattaaaataaatgttgggccagatgcggtggctcacgtctgtaatcccagcactttgggaggtcagggtgggcagatcacctgatgtcaggagtttgagaccagcctggccaacatggtgaaaccccatctctgccaaaaatacaaaaattagctgggcgtggtggcaggtgcctgtaatcccagctacttgggaggctgaggcaggagaattgcttgaacctgggaggcagaggttgcagtgagccgagattgtgccattgcactccagcctgggcaacaatagtgaaactctgtctcaaaataaaataaataaataaaatttaaaaataaaataaaataaatgtggaggaaagaactggaaatcctgaaatttttgttttttcaactttttcttcttttttaatacaatttagcaccaataataaagcatcaataatagtaaggcttttctacatatctgagatctcttccttaatatattatttatcacctccccaataatatatttgttacttatggagtgaaaagccttcaacctatttccttttgcagcaatagaggccaagcacagtgttactgctctcaagaaaaagaacacacaagcaatttcagcttagaaacaatacttaaaagggaggacagtttataaaattccatctaggttgcttgaaaatagctttctctatcttgccaataagtaatttactgaaacttctttgtactttgacctgaatctgtggagactctattctattaataatttgtaaagtttataaattccttcctacaaaagtttttcaacatatattggaatctggggtttcaaaagccttcctccttatttacttctctttgccaattaaaatcacacactgtttctttgaccaagaaatgggaaaatgactactctatccctatacactgtggcttccactaagtgggaggaaaggcttcctaggacatgtgtttaactctgtaatttgctctcgaaactgctgccccaatgtacccaaatatatgaatctctatgttctttttatttaacccaaaatatacctgatctattctgcactaaatatcaacaacaaagacagggctccaggaagtaacttgcagaattgtcttgtttaaaaataggattaacaagcttcttggtaaggtgagctttttcctgcctccctccccactcccacttctaaccctgtaacattctttgtttatgtacatttggttcagagggatacttctgctgctgccttattattaataatagcagattaaacttcagtgcctcagggttggaggattctcttttatactacaaacactttgggccgcccactataggaagtgccatgctaagtatattagggaggttcaaaagatgtgaaaagacacaccagtgctctcacaaagcttaccaactcactaggaaaataaatcatacactatgaaacaacatgaaagtaattactctgaaattttattatttttaacacatacatttcacaaacaatacctttaacaccacatacaattccataacaaaatattttaattttgtcaacgttcttttttgtttgttttttgagatggagtctcgctgtgtcactcaggctggagtgcagtggtgcgatctcggcttactgcaacctccgcctcccaagttcaaatgattctcctccctcagcctcctgcctcagcctcccgagtagctgggactacagccgcgtgccaccacacccagctaatttttttgtatttttagtagaaatggggtttcaccatgttagccagtatggtctctatctcctgacctcatgatctgcccgcctcagcctcccaaagtgctgggattacaggcgtgagccaccgtgcccagcctcaacgttctttaactttttacaatcttctctcaacaaaagtgtaacccaagataccttgacaagaaatcttccagataaatatttttgagctagtttcaatgatgcctatccactaaattttctctcaaatacttgcaataataataaagtcaacagtactctaggcaagagtatactgaggaagtacacaattaatcagttcttcccaaaaaataatcgtaatagtttcttcctcaaatcttttcttctgcaatgtctaatctcatccattgtatttttcatctcagacactgtagttttcatttatagaaattcaattttggtcttctttttatatcttccatgtcttaagtgtttgaacaagtgcaatacagttataataacttttattttccttctctgctaattcggtcatctatatcagttttgggttagtttcaattattctcttcattataactcatgggtttttttgccctttgcatgtctgataatctttgattcaatgctagacagtgaaaccacctctgcaaaaatcataactgagaaaattattacagtgaaagagatctgacataaccagctccatcttgcttctaatcaccaagctgtccttgttcatttctaggtacaggctgaactaacttttgggaggaatttagtttatagtttagctttgaaaccaagacaataacagccatttcccaaacaaactccattcctgcctggggactagactcccttttcaggacaacaaattagccaaaagattagaaattgtggtttaggagtcatgtagctggaagctgcccaaattgctaaacctccccaaattgctcctgcggataacatcactattgtaaaacctaagatcagtgcttgaaatattttgcagaccctaaactcagtcgatcggctggcataacccagattgataagctggctcatctggtcttgtggcccccagtcaggaactgactcaacacaaaaggacagctctgactccctatgatttcatctcagactgactaatcaaaactcctaactcactggccccctatcaaattatccttaaaaactcagatcgtcagattctcagggagactgatttaagtaataataaaactggtctcctgcatagccagctctgcgtgaatttctctttctctactgcaattcccgtcttgataagttggctctttctaggcagtgggcaaggtgaacctgttggatgggttacaacattgtgaattttactttgttgggtgctggatatttttgtattcctgtaaatcttgagctttgctcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactccatcttgatctccctaactcagggagtgttctagactccagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttcttttcaccctcttttttaacttattttgaaataatttcatactgacaagttacaaaaacagtagagagaggttctgtatacccatcactcagttcccctaatggtgacagcttctataagtatactgcactatcaaaaccaggaaattagctggcaaattaactggactatagaccttactcagatttcaccagtttttacatgcattcatttttcgggtatgtctttgtatatactcatgacattttatctatcacatatatagcttcatatataaccatcattttaatcaagatatggaactgttctgtcactacaaaggaagtcccttgtcatgtccctttaaagtcatactctccttctccttccctaacctatggcaaccacttgtctattctctacatctttaattttgtcgtttcaacaatgttatataaatggaatcatagagtatggaccattttgagattggcttttttcactcagaataatgcccttaaattcccttcaagttgtttacatcaacagattgttccctttgtcggtgaattaccttatgtggacataccatgagtcatatgaacattcagtaatggaaggatatttaagtcatttccagttttttggctattacaaataaagctgtgaacatttgtgtacaggtttttgtgtgaacataagttacatttccccaggataaatgcccaggaatataaatgctaggtgattaatggtagtttctttttttttctatttttttaagaaactgccagactgagttatagagtagctgtatcattttacattcccaccagtaatgtagaagagatccagtttctctgcacacttgccagcatttgaataatcagtatttttaatttttgccattctagtaagtatgtagtattttattctggttttaatgtgcatttccctaatggctagtgatgttaatatctttttgtgtatttatttgccatcatatatcttctatggttgcactgtttcttaaaagttacaagattaaacttctgtgtgcacgaatcatgttttcttcactactggggatagttcacttaggataaggatttggctatggtttaatatttcttgaatgaccaaaataaatacaaagacaataataaaacaaaaccccacaggcatcacaaacagaactcataatgctctgagattggggcctgcactttgaactctagtctagggatcagcaaactatagctcacgggccaaatctggccaggggcctgtttttgtatgccctgaaagctaagaagggcttttactttttttttttttgagacggagtctctgtcacccaggctggagtccagtggcatgatctcggctcactgcaatctctgcctcctgggttcaagcaattctccctgccttagcctcccgagtagctgggatttcaggcacccgccaccacacccagctaatttttgtatgtttagtagagacagggtttcgccatgttggccaggctggtctctaactcctgaccttaggtgatccatgcacctcggcctcccaaagtgctgggattacaggcgtgagcgaccgtgcccggccgggcttttacatttttaaagggttatttaaaaacaaaaaaatatatgcaacagagtccatatgtaatctgctaagtctaacatatttactatatggtgtttacagataaagtttgcagatgaatggaaagaaaacctgatcttcttttttggggcaaacattaacaacattgacatctgattacccatgatactctcaagatcttattctttaacaaaaaggtggggaaataaaaacaccataaaagcggccgggtgcagtggctcacgcctgtaatcccagcactttgggaggccgaggtgggcggatcatgaggtcaggaggtgagaccagcctggccaatatggtgaaaccctgtctctactaaaaatacaaaaattagccgggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatagaaataatgactgaagttgtgagaatagttttaaaacaatctaaattttagaaaggcatatgattccatgaataaatgaataaaaatatgacaaaatagctttagcttataattcaaacatgcttacatatgccaataattttggttatgctatgattcagagcacagttaaacaaacttgtattattgttttagattattgggaccaaaaataggtaactctcttggctccttatcaaattcaagcattagatcacaagttgattctcactatatttgatacccagtcacacactgcataattatgtttcagtcaacgatgaactacagaaatgatggttgtcccataagattataatagaggtaaaaaactcctatcacctagtgacttcgtagccatcctaatggttgtttaaatgcaatgcactacctgcatttgtggtgatgctggtgtaaacaaacccactccactgtcataaaaaagtatagcacatatgttatgtgtagttcataatacttgataatgagaataaatgaccgtgttactgatttatgtatttactatactttttatcgttagagtgtatatcttctgcttattaaaaaaaaaaaaaaaagttacgatacaacagcctcaggcaagtccttcaggaagtattccagaagaaggcattatcatcacaggagatgacagctccacgtgtgttattgcccctgaaggcctttcagtgggacaagatgtggaggtgaaagtgatactgacattctttacccagtaaaagcctagactaatgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaagttttttattttattttatttttttctgagagggagtctcgctcttgctcagactggagggcagtggcgcgatattggctcattgcaccctctgcctcctggtttcaagggattctttttcctcagcctcctgagtagctgagattacaggcgcccgccaccacgcccggctaatttttgtattttagtagaaatgggggtttcaccatgttggtcacgctggtctggaactcctgacctcaaacgatctgcccacctcggcctcccaaagtgctgggattacaggcgtaagccaccgtgcccagcctcaaaaaattttttaaaatgtaagtttataaagtaaaaatgttctttgggaagttgaggtgggaggatcacttaaggccaggagctgaagacaagcctgggaaacatagcaaggccttgtctctgctaaaaactttttaaaaattagctgggcatggtagtgcacacctgcaacctagctactagggaggctgaggcagaaggatcacttgagcccagagtttgagtttatagtgagctataattgcactccagtctatgcaacagagaaagcagctatctctagaataaataaagtaaaaaagttacagtaaactaaggctaatttattattgaagaaacttaaaaataaatttagtgtagcctaactgtacagtgtttataaagtctatagtagtaatgtcctaggccttcacatgcactcaccactcatcatactgactcactcagagcaacttccagtcctacaagctccacttatggtaagtgccctatacaggcgtaccatgttttatcttttataccagatttttactgtaccttttctatatatagatatacaaataccattgtgttacaattccctacagttttcagtacagtagcctgctgtacagggtgtagcctaggaataataggctactacacagcctcagtgtatagtaggctgtaccatctaggtttgtataagttcactctataatgttcacatgacaacaaaattgcctaataacacatttctcagaatgtatctctgtcattaagtgatgcatgactgtacttagattttcatcaaatttttgccacttaactatgggtttgcccattaagtggcatgcagttatatctgggagtgtataggtattatttttattcctgttatgttttttgttaatattctatgaattttaacagacaactttcttaattttcacgacatataaaatgaatacctaaaactgaaatttgatcttatgaagaccaccctcccctactccccaattcttcctttttctagttggcatctcatggatttagcttgtagcattcatccctatacacggtctaattgcaatgtcctccttgatgccattctggtaaaatttaaaggaaaacttcaccagcattaatttttttattcattaaaacaacaaaccttggccaggtgcagtggctcatgcctataatcccagcactttgggaggctgaggtgggctgatcacctgaggtcaggaatttgagagtagcctggccaacatggtaaaaccctgtctctattaaaaatacaaaaaaaattagccaggcatggtggtgcatgcctgtagtcccagctactcaggagggtgaggcaacagaatcgtttgaacccgggaggcggaggttgcagtgagccaaggtcacgccactgcactccagtatgggcaatagagtaagactctgtctcaaacaacaaaaaaaccaaccaatgacaaaccttaaaaaaatagtatcagccaccactgtagccagatataatgaaaaatgtacaaaaacgattcacatttgtgctactgagaatttgttgttctgaaagagcaagtttaaaatgtacataccaaacaaaattccgatttactccagtcacacgaagttagttttaaattttgcactataatatatgtattcagtttaagttcgagaattagaaaacagctcttctagaaaatttaaaaatcaattttacccaatgacaggactaatgagtcttcctaaatgatttaatgaggtctttttaaacaaaatgtctgcatcatattaatgataagcaactagaagaaaaaaagatgtcaaacatgaggacataataatggaaaaatataaaaaagctaaaatttccgttaagtgtaccacatttctacttatgtatggagaatggctattcatctgacagagcaaaatgcagcctccttaccagtcactgttacaacatcatctttacgagcttcagccatttcctgaacatggacttctgagttcacatcaacctctttccctgataactgtaaatgagcttgaagtgaagatgggaccttgacaataatagaacctgtaataaatataatggagagcttagtaatataaagaaatcaaaagtaccagagtctattataaatttgactgacagggtagcattgctcctgagacactgtttttactcctcagcatacagtatttatttaaaccttttccttattcccaggtgcccaaagtttccttactctcggcattcacagtaacttctgtcaagaatatgggttattagcacattattaactactagatctgcttttgccaatagtcctacacagctcatccaacaccagaaagtgagtaatttactacacatgtagcttatagataggatttgccattgagcatttaatatgagccagacccctaattacattatgttttaatccccatattaactttatgaggtattattatcgccccgattttatagataagaacttgctcaagttcccactagtgctcgtgctggaacctagactcagctcaataattacaaagcccatgcttttttttttattattatactttaagttttagggtacatgtgcacaacgtgcaggttagttacatatgtatacatgtgccatgttggtgtgctgcacccattaacttgtcatttaacattaggtatatctcctaatgctatcactccccactgccctgaccccacaacaggccccggtgtgtgatgttccccttcctgtgtccatgtgttctcattgttcaattcccacctatgagtgagaacatgcggtgtttggttttttgtccttgcagtagtttgctgagaatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgccacgataaacatacgtgtgcatgtctttatagcagcatgatttataatcctttgggtatatacccagtaatgggatggctgggtcaaatggtatttctagttcaagatccctgaggaatcgctacactgacttccacaatgtttgaattagcttacagtccacccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatatcctttgtccactttttgatggggctgtttgtttttttcttgtaaatttgtttgagttcattgtagattctggatatgagccctttgtcagatgagtagattgcaaaaaatttctcccattcagtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggtcttcttctagggattttatggttttaggtctaacatttaagtctttaatccatcttgaattaatttttgtataaggtgtaaggaagggatccagtttcaggtttctacatatggctagccagttttcccagcaccatttattaaatagggaatcctttccccattgcttgtttttgtcaggtttgtcaaagatcagatggttgtagatatgcggcgttatttctgagggctctgttctgttccattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaaaaggtccttcacgtcccttgtaagttgaattcctaggtattttattctctttgaagcaattgtaaatgggagttcactcatgatttagctctctgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctctattcctaattgaataccctttatttccttctgctgcctgattgccctggccagaactttcaatactatgttgaagaggtgtggtgagagagggcatccctgtcttgtgccagttttcaaggggaatgcttccagtttttgcctgttcagtatgatattggctgtgggtttgtcgtagatagctcttattattttgagatacgtcccatcaatacctaatttattgagagtttttagcatgaagcgttgttgaattttgtcaaggccttttctgcatctattgagataatcatatggtttttgtcgttggttctgtttatatgctggattatgtttattgatttgcatatgttgaaccagccttgcatcccagggatgaagcccacttgatcatggtggataagcttcttgatgtgctgctggatttggtttgccagtattttattgaggatttttgcatcgatgttcatcaggaatattggtctaaaattctctttttttgtgtgtctctgccaggctttggtatcaggatgatgctggcctcataaaatgagttaggaaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtccagaaatttatccatttcttctagattttcgagtttatttccgtagaggtgtttatagtattctctgatggtagtttgtatttctgtgggatcggtgatgatatcccctttgtcattttttattgcgtctatttgattcttctctcttttcttcttaattaatcttgctagtggtctatcaattttgttgatcttttcaaaaaaccagctcctgcattcattgattttttgaaggtttttttgtgtctctatttccttcagttctgctctgatcttagttatttcttgccttctgctagcttttgaatgtgtttgctcttgcttctctagttcttttaattgtgatgttagggtgtcaattttagatctttcctgcttcctcttgtgggcatttagtgctataaatttccctctacacactgctttgacataccagagcataccagagattctggtatctttgacataccagagattctggtatattgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttcctgaggagtgctttacttccaactaagtggtcaattttggaataagtgcggtgtggtgctgagaagaatgtatattctgttgatttggggtggagagttctgtagatgtctcttaggtctgcttggtgcagagctgagttcaattcctggatatccttgttaactttctgtctcgttgatctgtctaatgctgacagtagggtgttaaagtctcccattattattgtgtgggagtctaagtctctttgtaggtctctaaggacttgctttatgaatctgggtgctcctgtattgggtgcatatatatttacgatagttatctcttcttgttgaattgatccctttaccatattatgtaatggccttctttgtctcttttgatctttgctggtttaaagtctgttttatcagagactaggattgcaacccctgcctttttttgttttctatttgcttggtagatcttcctccatcctttattttgagcctatgtgtgtctctgcacatgagatgggtttcctgaatacagcacactgatgggtcttgagtctttatccaatttgccagtctgtctcttttaattggagcatttagcccatttacatttaaggttaatattgttatgtgtgaatttgatcctgtcattatgatgttagctggttattttgctcattagttgatgcagtttcttcctagcctcgatggtcttcacaatttggcatgtttttgcagtggctggtaccggttgttcctttccatgtttagtgcttccttcaggagctgttttaggggcggcctgttggtgacaaaatctctcagcatttgcttgtctgtaaagtattttatttctccttctcttatgaagcttagtttggctggatatgaaattctgggttgaaaattcttttctttaagaatgttgaatattggcccccactcacttctggcttgtagagtttctgccaatagatcagctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagactggggaagttctcctggataatatcctgcagagtgttttccaacttggttccattctccccatcactttcgggtacaccaatcagatgtagatttggtcttttcacatagtcccatatttcttagaggttttgttcatttctttttattcttttttctctaaacttcttgcttcatttcattcatttcatcttccatcactgataccctttcttccagttgatcgaatcagctactgaggcttgtgcattcgtcacatagttctcatgccttggttttcagctccatcaggtcctttaaggacttctctgcattgattattctagttagccattcatctaattttttttcaaggtttttaacttctttgccatgggttcaaacttcctcctttagctcagagtagtttgattgtctgaagccttcttctctcaactcgtcaaagtcattctccatccagctttgttccgttactggtgaggagccgcgttcctctagaggaggagaggcgctctgattttgagagtttccagtttttctgctctgtttttttccccatctttgtggttttatctacctttggtctttgatgatggtgacgtacagatggggtttttgtgtggatgtcctttctgtttgttagtcttccttctaacagtcaggaccctcagctgcaggtctgttggagtttgctggaggtctactccagaccgtttgcctgggtatcagcagcggaggctgcagaacagcggatattggtgaacagcagatgttgctgcctgatcattagtctggaagttttgtctcagaggagtacctggctgtgtgaggtgtccatctgcctgtactgggggatacctcccagttaggctactcgggggtcagggacccacttgaggcagtctgtccattctcagatgtccagctgtgtgctgggagaaccattactctcttcaagcctgtcagacagggacatttaagtttgcagagctttctgctgccttttgtttggctgtgccctgcccccagatgtggagtctacagaggcaagcaggcctccttgagctgcggtgggctccacccagttcgagcttcatggccactttgtttacctactcaagcctcggcaatggttggcgcccctcccctagcctcgctgctgccttgcagtttgatctcagactgctgtgctagcaatgagcgaggctccgtgggcataggaccctcagagccaggcgtgggatataatctcctggtgtgccgtttgctaagaccattggaaatgagcagtattagggtgggagtgacccgattttccaagtgctgtctgtcaccccctttctttgactaggaaagggtactccctgaccccttgcgcttcccgggtgaggcgatgcctcgcccttcttcggctcacgctcggtgtgctgcgcccactgtcctgcacccactttctgacactccccagtgagatgaacccggtacctcagtgggaaatgcagaaatcacccgtcttctgcgtcgctcacactggcagctgtagactggagctgttcgtattcggccatcttggctccaccccaaagcccatgcttttaaccaccatggtatttcacacactcctacctcatcgtagtacaggacttgtgacctcattattataacacaactagaacactgagctcttgtgctttcagatgtgccttgtgtgtaacaaaaaataacaatagaaaaggattatttgaattccaactcactaatgtttcttttgagtagattacaggcttttggatacctaaggtaagacactcaacctgtatttccatacaacctggctgtaattcaagcttctaaaggagtaaatcaggaaaagtactctgttaggtatggaatcatttttcgaattatgtgggttgcagcgtaaattcaccaacacactcctatttcagaagtttttcttcctgtttttcattaaataaagtaggtaaaaggcccctgccataaagcattaaccccacctctgtggacaaagatagttaggatggggtttagaatgcatttacttatgggtcgtggttttccttccaatctggctaacatcagcttaagcttccttaagtaatttcttggtcttcctaactggagctagaagtttgagataaacatgatgaactgttctattctaaaaaaaattagggaacaatgcatattactagaactagtttattttattaagaaataaattgcagccaggcacagtggcttgtggctgtaatcccagcactttgggaggccaaggtaggtggattgcttgagctcaagggttcgagaccagcctggacaacatggtgaaaccctgtttctacctcccccagctcaaaaaaaaaaaaaaaaaaaaaaagctgggtgtggtggtgcacaactgtagtctcatctacctggaaggctgacctcccaagcttaggcgatcctgatgaggctgcactgagccatgaccttgctgctgcactccagcctgggtgacagagtgataccctgtctcaaaaacaaaaacaaaaaaccaaatttctttccagggttcaaatgtaaactacagacaggagattcccataacaacatatgagggctttaggaaaaaacaaaacaaaaacaaccctggaagatttcaggataaatagaggacacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctggaacgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagttttacagttttctgtttgttttattttgcctactgtgcaaaacattaaattatttgtatgtaacagctgcttattcaaaactttgttcttactctgttactagttatattaacaatatatccttcttctctttggatctttgtgataatggagtacagttatatgacttacatgccatttataattttccctgaagcgtattacctgaagctcttagatttagtgaggacataagtttatcctattttaaagggagaaaatatgatattgagaagtcacaccggtgcatcagcaataactgaggtttcagacctctgtgttttgcagttttgacactgacaaattctagagatggattaaaaaaaactattacatcaatatggtaaagcaactactaatagcaggaacaatcagtctctgtgaggaaatattttccttgttaaacatctggccaacatgcaagagctgctagactatttaaaaaatttttttatacagagctacagttcttaactttctgcagccaagccacttcagcccctatggccaacctacttcacccaagccacttgtcaacacatatgtgtacatccatgtgtgcagaagaacagacaaattcatatttatctttcagatgaaaagtataccattttaaatgaaagagttggactcagaataagttgtgtcagaagttaaatgatagagacatatcataagtcttgatacttcaagagactaagtaatcactttagaggacctttctgtgtgatacctttatttaaggatcacactttgaaaactgttactctacactgattgcctgagaagttccttttacaggctggcagagaagcttccaaaagagtgtatggcagtgtttttccttcaaagattattctatttcagaatagaataaactgaaaaatccacagagtaacatttaaaaattccataataacagtcaaaatattacatttttgtttgtactacaaagggaaagatagtctgcatggccatctatcccaaaagttgtaaagatcactggtctagaaagctagcagaccagtgcctttaaattaggttctatcagaagatattttcttgaaatcactatgtcagtatagataatttgaccatctgtttcctgagtgttacataaaccttccttacatcatatgtcaaaataaaacattccagttcactaacctttatgggatttcaattccactttccccagttggctgacataaacatctatggcaccctgattagttgaggcttttagacatccagaagacgaatctaggaagaagaaaaaa

SEQ ID NO: 1228 - DNA, 6588 bp, Homo sapiens
tcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgata

SEQ ID NO: 1229 - DNA, 7815 bp, Homo sapiens
aaaagtcaatttctaatggctttctttggtcaccagatagtcacatagaataggcaaagcctacagaacagaaaaataagtaattgggtgccatgtaataatactacagggatttgaattaaggattgacatttcattttaaatgaaattgtgtaactggcttttaagtacattttaaaaggattgggtaggtacttgggtcgatacttctgtttgaggtgttcaagccacaaatatacaaatatatagctatcactgataaacctgggaagctgacccctttaggctaagttggccttcatgagatcagaatgcccagcacctgtgtatcagggtaacaccagctgactccttgatatagaggttctggaggatgtcttaccaggacagtcagggaagtcaggattttgtttgtttgtttggagatgaagtctcactctgtcacccaggctggagtgcagtggcacaatcttggctcactgcaacctccgcctcctggattcaagcgattctcctgcctcagcctcccaagtagctgggattacaggtatgcaccaccatgccctgctaatttttgtatttttggtagagacggtttcatcatgtttagccaggctggtcttgaactccagagtcaggatttgaccccgcctgtgctgcaaccttctgggacctcctgtaggaagtgctatacctgctttggaagaagcagctctcagaggaaataacaccaatgggttcctccccaagagatcccagaaaccagaggtggaacttaagctggcttgtattttttttatcaatgctctgactctgtatctcagtggaaaattctattcaacaagaagaggagggctgggcacagtggctcacacctgtaatcccagcactttgggaggccgaggtgggcagatcgcctgaggtcaggagttcgagaccagcctggccaacgtggtgaaaccccatctctactaaaaatacaaaaaattagccgggtgtagtgccacatgcctgtaattccagctacttgggaagctgaggcaggagaatcacttgaacccaggagaggcggaggtttcagtgagccgagattatgccattgcattccagcctgggctataagaggggaactctgtctcaaaaaaaaaaacaaaaaaaaaaaaacaaaaaaaaaaaaacaggaagaacataatttctcctctagaactaaaaaatatttgtattttatcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgata

SEQ ID NO: 1230 - DNA, 8610 bp, Homo sapiens
aaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaa

SEQ ID NO: 1231 - DNA, 18389 bp, Homo sapiens
cctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaaca

SEQ ID NO: 1232 - DNA, 299866 bp, Homo sapiens
gttcagccacaaacaaatagacctctactctctgattgaatcttaaatgagccaatgaaaatgaagtccctactcccaatgtaacaacctagtaagaggtggaccaagaaagaatatgacctggttttaatggttaggagaactggtacaaacacttattagatctctgatcaggaaatactgcttctgagatcactgcttttcttaaaatgtgatatttaaggtatgaatgaactcctttgacttctcccttaagtacacaaataatgtgagcagggcaatatgggtagatcatgagctagagaccattgataaaagataaggccaaagcaggaatacctgagccctgaggagattgtacaagtttccagagagacagagagaaaaaatttcctttaaaagatcaagaatttgcatagactttttggcagtactgaaagctagaaggctgttctgaaaatgcacagtgaaaatgatttccaatctagaattctgtactatcaatcaaatgtaaacataaaaataaacattttcagacacacaagatgtggaaaaaaaactcacatgcatccttttctaggaaactactgtagcatatgctcccccaacacagagtaaaccaataaaagagaatacatgggatccaggaaatggaagatctagtacaagggaaaggtaaagagaattcctaggatgacggcaaaggagaatatgaggaagataactagagtgcaacttgaccaggctttgcaagtaagaggtgtctggaagagatgtctctgtgaagatggaattgttaggattcctgacatgttgggatatattgaataaagatttatataactgagattttttttagggatgaagaatagtaattacataaaaattaagccaataaaatattttttgtaggaaaggaaaagtatatatagtatactacatggatcagtcataaatatcatttacttaattataataaataaatatctgcccaaagatcaacctgtcatattctgatttcttagtacatcaaaatttttactactaatggtttgtaaatgttgagcatatttctgtcagctatttataatataatatgtgcataagtaattactcatcaattattattatttttaaagaaaggatctcactctgttgcccaagttgaagtgcggtggcacaattatagctcttgaaactcctgggctcaagggatctccccacctcagcttcctgagtggctagaactatgggcttgcactaccacacccagttaatttaagatttgtttttagagactggatctcactgtcttgtccaagttggtctagaactgctggcctccagtgattatctcaccttggcctcctcaaatgctggcattaccggcctgagccattatagctggccaattatttcttattttctaagcattattttagagagagcaagtcaatgaccaaacttttgaggatctatgttacatatttaagatggaaatcataaatatctatatataatgaataattgatggtaattaaaaatatgttttaagtggatactcataaatacaacaatgcatgtttttattatatactttgatgaaaatgatttttctttgaaaagagtcagtgcacttccattttgcctgtcaataagatattgtcattcactataacagagaggataaaaaattgcaaataattttcatgaagatactaattaaaagagaaaatgacataatgggatgctgtatcaaatactgcattaaaggatagcaatcataaatatttgtggtttgtggatggaggtaatggggatatactcctaaagtaatacaatgctgctactataatataacaaagttatttttccttttttttttttgaaatgtagtcttgctctgttgcccaagctggagtgctgtggtgcagtcagctcactgcaacctccgcctcctgggttcaagcaattctcctctcagccccccgagtagctgggactacaggtgcatgccaccatgcccagctaatttttttttgtatttttaggagagatggggtttcaccatgttggccaggctggtctcgaactcttgacctctgcctgccttggcctcccaaagtgctgggattacaggtgtgagccactgcgcccggccttttccttatgttttccaatcagatctcttttggttaccttattttcaaaatgtagtgaattaaagcaacattaaaaaaaaaggtgaacttagagggtcagaatggtataatccagttataaatctgagtggtttgaccattttcattataggcagaagactactggttaactttctaaaaacaaaaccatttctttcatttttgaaatataaaatgctatattaagccttttctcaagcaactattaagagagcacttactggcgaatgtacaaaaactctatttttgagtaattatatacctaatgccacttgaactaaagcatgtaagaaaaatgtgtgcatttttcttcatttaaggactcgtctatggtaaaaatgtatgactttttttcaaaacaaaagcagtgggaacatgggagaaacatgccttctttattgctgaaatatatattttcagtggttatactcttaaggaaatcctaaagctgtaatgcatttggtgtttttttttttcctgtaacacaataagaataaaatggcagctcagcatgagacaactattatacacaacatcagatatatttcaggtatttgaaagctggaatttttctctaccatgggttatggttttagctttataactgccttgctgtgaaattggacaagtcatttaacccttcttaattttcttccaccaaatcgcaaatggcaattattaaactccatactattttatctatgcatatactttgctattctatacagaaatatccctactaatggtacttcctgcaggtctgtctaaaatgctcagtgagtgacctgtaatccagctctccacttagtgaatgttactcttacctgtggagtcccttattaacaacatactgactctgcccttcaagctgcctgatatttacactcaaacacaactaccctgtctatgctttcctcttgtcagtgtggtctgtaggtgccacatataggacacttttagcaactatgtcaatcagatcaagtgattcttttgtggacttttaacctcaagcagaaataaaagttttctcacatttaccacatttaggacaatcctctttgatttaccactcggcaggtgagtggcaacacattatggtccttttgccttccattaatatttgtaagacttttttgtatttttttaagttccatatatagggggtacatgtgtaggtttgttacatgggtgtattgtgtgatgctgaagtttgatgtatggattctgtcacccaggtattaagcatagtacccaatagggagattttcaatgccttccccgcaacaagccaccctgcatagtctgcaatgtctattgttcccatgttatgtccatgagtgctcaatgtttagctcatacgtataagtgagaacatgagatatttgggtttctgtttctgaattaattcacttaggacaatagcctccagcttcatccattttgctgcaaagaatatgatatccttttttatggctgtgtaatattctatggtgtatatgtacaatcatgatggcctatatgtatattaagaattaaatagtaatatatatgcatagtaaaattatttatggtagaattataattttctagatgaataagtaactctaattcatgaaaaagttgtcatggcttgatttcctgcaaagtcataggtagatcctgagttgttactgaagctaatattattttacacttatatagcaggttgtaatatgctcaccattttgcaaaacattgggaatgaaatttgacctatcaagaaatcaaagtatgacagtttgatacgtgtgtttctttcttgagatctttcagaggttgcatgtatgtcaggtaattatcttttatatagcaaagtaaagattgctttataaaagcttttaagtttctggaaacatgaggaaattttcaagattttcataattttattcaagtaggaaatatcagacatggctctggaataggaacatacagacttgtgttagcaatatcctttttagaaaatgcagttggtgtatgtagcacccccagaaagaaagaaacgtgaagatgctctattctgttcctgaccactctgagtatcagactgctatctactgttttaaggatttagatttttgccagagccaaatatccagatatagctatagtaggctggattttctatcttggggatttaatagcagaataaaaatagtaattgggggccgggtgcgatggctcacgcctgtaatcccaggactttgggaggttgaggcgggcggatcacgaggtcaggagatctagaccatcctagctaacacagtgaaaccctgtctctactaaaaatacaaaaaattaaccgggtgtggtggcgggcgcctgtagtcccagctacttgggaggctgaggcagaagaatggcgtgaacctgggaggcggatcttgcagtgagccgagatcatgccactgcactccagcctgggcaacagagcgagactccatctcaaaaaaaaaaaaaaaagtaattgggaatgagcatgtatttaggaataaaactataaattttttagtattcattgatacatgtgtaaacatatataaaatctatgaatataatggaaagatttctgacatcaatacctagttatcttcttatctttcaaatatggtacttccagggcagtaaactcactttgtatttagctggcacatcttgcattattctgttctcttcattccacttatatgtatctcatgtcattttttgtactacattttgatacttggatagtcattatttgtattattagttgccccaaattttcaatctttacatcaacaagtactcaaagttgagtctaatactgtagcttaggtaagttctgtagtgattttgcttcttgctaatatgctctacaaaatgctggctccctggtttgtctattaatcccagcactgacttctgtctgtcaggctctgcaactttcatttgatcttgaatgtatgtccttgtgttggcttttgatacatagatgtgaccaggaagacccttttcttgggaagaatcccttttgagttggaattttagctcaggaatagatgcaaagggccatattgcttcctaaataataatattaaaaatgaccaatattttctgcttatcatactacttgctgtttatcaagtcttcatttctcacctgggtttaggcactggtaagaacagtaaaaattctggtccaaaaaatgtaataaacatttcttaaattccatttgggtactaaacactattctgggtcttccaacttttattatcttccagtcctcaaaacaaacctggctgatagatagtactgttatctgtaagattaataaactacttctcagatagacaatgtgaacttcccagggtcattcagctggtaaatggctgcattcaggtgtcttgactgccacttcaatgattcataatcgatatggtttggctgtgtccccacccaaatctcatcttgaattgtagctccggtaattctcaaatgtcgtgggagggacccagtgggaggtaattcagtcatgggggtgggtctttcccatgctgttcttgtggtggtgaataagtcttacgagatctgacggttttataaagggaagttcccttgtacatggtctcttgcccgctgccatgtaagatgtgactctgctcctcttttgccttccaccacgattgtgaggcctccccagcaatgtgaaaatgtgagtcagttaaacctctttcctttacaaattacccagtcttgggtatgcctttattagcagtgtcagaacagacaaatacaataattttgcaaaatttgagaccttttaaaatggcacagaatagggctcatctcagtgaatattctacgtgcacttaaaaagaatgtaaactttgcagggtaagttaggtgttgtaacctaaacataaaaattatgttaaagtggttgatagtgtttttcagactatgaatttaattttattataatatcagttgctgagagaggggtggtaaaattactatgattgtggaattatatatttctcccttgagttttgtctcttcttttgacttcatgtattttgaagctctgttattaggcacatacatatttatgatcattatgtcttcctgatgaattgacctgaccagtgttatgaaatgtgccactttactgctggtaatactgtagcttgtagtccattttttctgatatttgtataaccacacaagctttcttacccttcccatttgcttacttaccttcagcctagttgtatttttatactaaaatatgtctcttctagctaatatatacttgggttttgctctcttttttaacccatttttgataatatctgtcttaaagttggcatgtttagtttgttaacaattaattattgctgaaaggattgactttgggcttccgtaccagttttttatttggttctgtttgtcccatctgtttttgttcctttgtttttttcctgccatctcttggattactctagtaatttttgcatatgattttaatgtaactattgactttttagctatatctcttgcactcttttttttgtgctttttctacaaattaccataagcacctacttagaaacagcatttgtcacttaatgtaatgggcaataaacttgcaactatataaatctgattcttcttcctgtaatcctctgtgctaggctgtcatatttattacatttacatacattttacagcctcacaggatgatgctataatattttctttaaaatgtcctatggattttaatgaaattaaaaggaaatgtagctttttatatttggctccccactttttataaaaacatttttaaggctttttatttcttcctaaagatccaggtttttatatggtatatcttaagcctgtggaaccccctttatcatttatttttatttttgcccactcatatactctgtttcttatttttattgtttctgggccattggctttaagtgtatagtttttctgtaaacaacagacatctgcatttactttttaatctaatttgagactttaaaaaataatttcagcttttattttagattcaggtggtacatgtacaggtttgttacatgggtatagtatgtgattctgagatttgggatatgaatgatcccttcacccaagtagtgagcataatatccaataggtagatttccagcccttcccctcctctggtagtcttcagtgtctattgttctcatctttatgttcacgtgtacccaatggctagctaccacttataagtgagaacatgcaatatttgtttttttgtttgtttgtttgtttctccacctagcataataacctccagctgcatccatgttgctgcaaaggacatgattttattccttgttatggatgtatagtattgcttagtgttctatgtaccacatatttaaaatccaatggcctgttgatgggcacctaggttgcttccatgtctttgctattgcaaatgatgctgcaataaacatatgagtacctattgtcttttggtagaatgatttactttttatatacccagtaatgggattgctgggtcaattggtagttctgttttaagttctttgagaaatttctaaactgctttccacatcatttgttatagcagtgaatttctgttgacaatgaattctcttagttttacttttagaataaaatatttttacttttattcttaaagaatattttcaccgagtatagaatttttgattttttttttttagtttcagtacttcaaataatacttttccactactttttggacttagccatttctgatgaagagttattggccattcaagttgttgttcccttatcatttttctctgactgctttcatgattttatcactcagaaatctgactgtgatgtgtttaggaattgttcttttcatatttactctgcttggggttcactgagcttcttgaatatgcacacttattttttgcccaatatgggaaagttttagtcactatttgttcaaatatttttgtgctttaaaaaattacttcttctggaactgcaattatgtacatcagcacttttgcttttgtccaaaagttctctgagttactattcaccttttatctatctttttttgttctgtcttcatgttaggtaacttgtattgattcattttaaggctcatttatttttctgtcgtttccattctgtttttaagtaaattcaatttaagaaatctcagatattgtccctttcagttctaaaatttgcatttagagtttaaaaatcactttttaactcttctccaagatttttttaaacaatttctcattgtgatactattttcattgagaataattataataattcttttaaaatccttttgtgataattttactacttggtttttcttgtaatatgtctcagttgatgtattttctcttgatctgggctagacatttctgattcttcatgtgtcaagtaatttagaattgtgtctggggcattgtgaatgttatagagactgaatttggctgtatttctctgaagtatgttgatataattaattggttggagtcaaatggtaaactctgcctcttaactggcagctcagatctcggttcagttttttcatctttaacctatactgctctgagtttgcctagtgcatttgtagttttaggggtcaaatacatggacagggtttcggaggataatttggggctcaaatctgtgccttttcatttccctgattcctctcctatttatgaatatctataatttacctgaacttttctctgattttctaggatagaaagactgtggatttttctgttgtaattttagcaaattttatgtttccaacttcagtttgcccataggggaaaagccataaaaactgaaaatgcactccattctagtcccttttggccctgtagaatcttagccttactggaagccttattttgcattattgtctaaactgttgtgggctttaaaaaatattttaatatcataacttagagtttcacaatatcataatttcattttatattcaaatacaaactatttcatgataattaaatctttccaaagattcctttagacactttcccaaattgaatttttgtaaattatactcaaatactgatagagtgatttcacaagtaccaaaataaaatattttttcattgtgggcatttaaattaactaaatgtattatcaaactctattagaatgctaaacattatgaagcaagcttaaagtttataaagcagctttttcagtattcagaagctgcaatgggaattttgtttctgtgaagaccaaagatttgtgatctatgttggtggtgatcatagaagaaaaatcaagggaataaattgttgtgccaaaattacctgtataggcagtgtttttgatgtcatagagcaatcttggcttccctttcttattataatggtatcagattctcattgttaaagaattcctcatccccagctactctattactttggaatttgtagaaaggtcagtgagtctcaggagttgtgattactttttctagctgacatttattgatctcattaccttcatgctcatatttcagaaaaatttttttcattctgttaccatttcaaagatgacagaaatgctgcagtgctcactgtattagaactgtatgtaattaaaatttgtactgtgtttcatcacaattcactgtcagaaccatagcatgtgttgtttataaattagattgttataattagaacacacaatgtgcataaagaaggctgaatttatatgctaacatatcttttatatcttttcatgaaaatgaatgttgtagaatctttgggaataaaacattttactagtactgaatggctcacttgactctcgccgttgccagtgcttcgtcttaaacgattgcttttgcaaaatcatttctaaaaaagattctagagacaaggaatattaaagagatgtgtataaagatgattaagtaaactatacataaccatgttttaatttttcctaagactgagccataattagataggtttattataaatatatagatttataatatatgtaatactttcaaatatttaaactcacagttctagcccaattttacttgtctacatttaaaagaaaaactttaaaaggatggtgaaatagtttttaaaaaggtttatttgcatgaggtagatttaggaacagtttttcttttgtctgtttaagccacaattgtacatactgaattccttcttcctatttgccaagagaccatccaaccagaaagatttaaaaattctctctatgaaagtcaagaataggcacaggacattcagctgtcatgatgaatcagaaaactaatctatgaaccatttgctggaggttattttagatggattaatttacagaacaccctagtttacagaggctaataaattatagttgatagttatgatcaaaaccattattagataggtatgccattgtttatgtatacatcttagtcctttgggccgtagatttggcccctattaattcacttctgaggattattaatttctttattctcatttctaatttgagagataaaattcagagaagcatggtttgcccctcactggtggttcatcggttttaaggacctactgatactctgtaacctaaagtttgttcatatttctgacaaatttgcaatctctctctttacttgtatttatttaaagattactgacacatgacattcatcagtctcaggcaaacgctaacctcactgccaaacacaaagacataatcatttttgacttccgcattaggctcaaaaaaattctggattgaaatattcactaaccataacagaatatactaattccaagaaataagtgtattcatgtgccattttataaggtcagcctaatattcctgaagaaaacacccccatgttctttcttataaaatgacttcttattatttttaatgacaagcatgttttatgatatgtggataatacatgtgaagttcagagattctctgtgtaattaatgaattaatctaggtgggagataaactagttttaaaaagaaaatgagtctattttaataacactcatgtcttcagatattggtcagagaccagaactgtcttgtcaacccaagacattttttttcaataggcattattatggataaagcggattatttgaaatcaaatcaacaaatttactgactagtaccatatattaggtgccatgctggctgtagtagaaaatatgaagatgctggcaccaagtactgggctagtcagttatagatattattttatttattcccaacaatgttgaacggggcattagttccatttttatagctgatgatataggctgatggttaagaaatagtagagaaattattagataccagcaatgccaaaatgcaaagcccttttgtttattgtagcatcttcatatttctttgatcatacgtatactctgaatgaattatgaaaactatgctccctctcatgcatgtttaagttgaaacccaaatttttttcatcacaaataagttattataaataatgtgcttttgacatattgcaaatattggcatttaaaaatttatctccagatcactcacttaaaaatgtccaattgcatctaaatatcacaatgatttgatgctcttcatcatttattttttagaaagtacacacacatattgtttatgtcatagaagtgaatggctgttaaaatttgtgtcagctggggttctccagaaaaacagcaccaacgggatatacagagagatatataagagcagatttattaccggggttggctcgtatggttatagaagtcccacaatcttctgtttgcaagctgcagaaccaggaaagcagagaaagcagagggagtaatttggtctgaggagaatgtgattgaggttggtgatggtgttagagctggtctgagtccaaaactctgagaaccaggagcactgaagtccaagggcaagagaaaaatagatgtctcagatcaggcagagtgatcaaattcacactctttctgcctttttgtttgtatacaggcccttaataaactgaacgatgcctgctcacatgggctagtgtgatcttctttactcatcctactagttcaaatactgatcccctgtgggaacatcctcacagacacacccagaaataatgtttacccagagctatgtgggaattccttaccccagtcaagttgacccatgaagttaaccatcacatagttacatggtcaatagaaataacctttggttataaccctttggtcaatagaaacaatccttgcctctgcaatttttctgtccactcagttaatattaatacttctaccatttatgctggtttttatttggcaaacttttatatattcttatatttttaacattcgtgcagaattttgttttacatatatctcttctaggcagaatatatttttaaattttttaaatttttaatttttgttggtatatagtagagatatatatttatgagtgtatatatttatagaatacatgagatatttgatacaggcattcaatgtgcaataatcatatcagggtaaatggggtatccatcacctcaggcatttaacctttctttatgttacaaacaatccaattatactcttttagttatttgaaaatgtatgataaattattgttgactgtagccaccctgttatgttatcaaataccaaatcttattcattctatctagctatatttttgtgcccattaaccatccccatttccctctccaccattacccttcacagccttaggtaactgcattctgttctctgttaccatgaattcaattgttttaatttttagcttccacaaataagtgataacattctatgtttgtctttctgtgcctggcttattacacttaatataatgacctccaattccatccatgtttttgcaaatgatagaatctcattcttttttatggcttcattgtaaatatgtaccacattttctttattcattcatctgttgatggacgcttaggttactttgaaatcttcactattatgaataatattgcagtaaacatgagagtgaagatgtctcttcgatatactgatttcctttctttggggatatacctagcagtgagttgtctggattatatggtagctctattttaatttttttgaggatcctccaaactgttctccatagtggttgtactaatttacattacaacgtttgaaccaacagtgtacaagggttcacttttctccacatgctctccagcattttgtattgcttgctttttggatataaggcattttaattggggtgagatggtatcttattgtagttttaatttgcatttttctagtgatcagtgatgcagagcacattttcttatggctgtttggcatttttatatcatttttaaagaaatatctattcaaatattgtgtccctttttaatcaggtttgtagatccttttcctgtaaggttgtttgtactcatatattctggttattaatctgttgtcagatggatagtttgcaaagattttctcccactctgtgggttgtcacatcactttgctgactgtttcctttgcagtgcagaagctttttaaattgatgtgatcctatttgtcaatttttgctttggttgcctgtacccatggggtattactcaacaagtctttgcccagtcccatataatggagagattccttaacgttttcttttagtagtttcatagcttgaggtcttatatttaggtctttaatgcactttcatttgatttttgtatatgttgagagacaggggtctagtttcattcttctgcatatggatatccagttttcccagcaccatttattgaagaaactgtcatttccgcagtgtatgttcttggcacctttgtcaaaaatgagttaactgtagatgatggatttgtttctgagttctcttttctgttctcttttctggaacagaaaactacttctagatgaatattggcggaaaaatcctcgacaaagtatttgcaaaccaaattcaaaaataaaataaaagatcagtggaagagaaaaggaaacccaaaaacaaatccatacatctacagtgaacattaaccattctgttggataataccatgctgttttcatgttaataccatgctgtttttgttactatagctatatagaataatttgaggtcaggtaatgtgattcctccagttttgcttgttttttttttttttgctttgcttttgttcaagatagctttgactattctgggtcttttgtggttccacgtaaattttaggattgttttttgtattttgtgaagaatgtaattggtattttaatagggattgcattgaatttgtagattgctttggatagtatgggcattttaacaatattgattattttaatccgtgaacatggtgtcctgttcaatttcctttttcaaagttttgtagttttcattgtagagatttttcacttctttagttaattcccagttattttattttatttgtagctactgtaaacgggattactttcttgatttctttttcagattgtttgttgttggctacagacatgctactgatttgtgtatgttgattgtgtatcctgcaactttactgaattagtttattctcatagatttttggtggagactttaggtttttccaaatataagactatatcatctgcaaacaaggataattttatgtcttccttttcattttggataccctttatttctttctcttgtctgattgctttagctaggacttcgagaaatatgttgaataccagtggtgaaagtgggcatgcttgtcatgttccagatcttagaggagaggctttcagtttttccctatttagtatgatactagccgtgggtctgttgtatatggattttattgtgttagggtatgtttcttctatagccaattttttaagagtttttattctgaagcgatgttggattttatcaaatgatttttcagcatcaattgaaatgatcatatggtttttgtccttctttctgttgatatgatgtatcacattgattgatttacatatgttgaaccatctttgcatcctagtataaatcccacttggttatggtgaatgatttttttttttttttgagacagagtcttgctctgtcacccaggctggagtgcagtggcacgatcttggctcactacaagctccgcctcccaggttcacaccatcctcctgcttcagcctcctgagtagcggggaatacaggagcatgccgccacgcccagctaattttttgtatttttagtagagacgggttttcaccgtgttagctaggatggtctccatctcctgacttggtgatccacctgcctaggcctcccaaagtgctgggattacaggcgtgagccactgcgcctggccgcatgatctttttaatgtatgtttgaatttggtttgcaaatattttgttgaggatttttgtgccaatattcatctagaagtagttgttttgttcaatgttcttcctttggttttgatatcagggtaatactggactcattaagtgagttttgaagtattccctcctcctttcttttatgaatgcttggtaaaatttgtcagtgaagccatcaggtcctgggcttttctttcctgtgagactttttattgtgggtttgatcttgttattggtccattcagtttttggatttcttcgtggttcaatctttgtacgttgtttatgtctaggaaattatccatttcttctaggttttccaatttattgcaatatagttgctcatggaagtctctagtgatgctttgaatttctgcagtatcagttgtattataatgtctcctttttcatctctgattttatttattataatcttctctctttttttttagtctgcctaaaagtttgtcaattttgtttattttttcaaaaaaactttgtttcatcagtcttttgaattgttttcttcatttcaaattcatttatttctactctgatttttattatttcttctactaatttttgctttggattgcttttgtttttctagttctttaaggtgcatggttaggttattaatttgaagttatttttcttttctcatgtagatatttgtagctataaacttccctcttactactgcttttactgtatctcataggttttagtatgttgtgtttccaatgtcattggttttaagaaaatttacaatttttttcttaatttcttcattgacccacaggtcattcaggagcatattgtttaacttccatttgtttttataatttccaaaatccttttgttattgttttcaggttttattccattgcagtcagcgaagatattggatgtaatttcattttttttttgaattttttaagacttactttgtggcctgacgtatggtctgtccttgagaatgatccatgtactgaggaaagcatgtgtgctctgcacacattgatgaaatgttctgtaaatatctattaggtccatttggcctatagtgcagactgagtctgatgtttccttgttgattctctgtctggatgatctgtctcatgctgaaaatcaagtgttgaagtttccagctattattgtattgggatctatgtccctctttagctctaacaatatttgctttatatatctgggtgctctagtgttgggtgcatatatatatttacaattgctatatcctcttgctgaattgattcctttatcattatataatgactttctttgtctcttcttaatagtgtttttaatctattttgtctgatataagtatagctactgctgctcttttttttttttttttttttggtttcccttggcatggaatatctttttccagtccattattttcagtctccgtgtgtctttataggtgaagtgtatttctttcgggtaatgaattgttgggtcttgtgtttgtgtccattcattcattctatgacttttgatcggagagtttagtccatttacattcaatattgttattgatatgtaaggacttactcttgccattttgttatttgttttttggttgctttgtggtctgcttttccttctttcattccttcctgtctttctttcagtaaaggtgatcttctctggttgtatgttttaattttttcctttttacttttttttttgcgtctgttgtttgattttttatttgaagttaccatggggtttgcaaataatataagccattattttatactgatgacaatgaattattgcatgaacaaataaacaaactaaaaaacaagcaaagatacaactaataaaaactctacactttaacttggtcccgctgcttttttaaaaaactctttattgtttgtatttatattttactgtattgactatgtgttgaagaattgctgtagttatttttttgataggttcatatttcggtatttttactcaagatataagtagtttgcacactacaattactgtgttataatattctgtgttttactgtgtacttactattaccggtgagttttatgtgttcaggtggttccttattgttcattaacatccttttctttcagattgaagaactcccttttgcatttcttgtaggacaggtctggtgttgataatggccctcagcttttgtttggaaaagaccttatttttcttttacatttcaaggatatttttcctggatgtgctattctaggataacaatttttattcttcagtactttaaatatgtcatgcctctctcccttctggcctgtaaggtttctactgaaaagtctgctgccagccatattagagctccattgtatgttgtttcttttttcttgctgcttttagaatcctttctttatccttgggagtttgattgttaaatgtcttgacgtagtcttctttagtttaaatctgcttgttgttctataatcttcttgtacttgaatgttatatctttctctgggtttgggaagtgttttttgttgtccctttgaataaaatttctctctctctctctctctctctctctctctctgtctgctctttaagactaataactagctgggcgcggtggctcacgcctgtaatcccagcactttgggaggccgaggggggcagatcacgaggtcaggagatcaagaccatcctggctaacacagtgaaacaccatctctactaaaaatacaaaaaaaaattagccgggcgtggtggcatgcgtctgtattcccagctattcgggaggttgaggcaggaggatggcgtgaacccgggaggcggagcttgcagtgagccgagatcgcgccactgcactccagcctgggcgacagagagactccatctcaaaaaaaaaaaagaacaaaaacaaaaacgaataactcttgtatttacgcttcattctttttatccttttttcttttgtgtcttctggctgtatattttcaaataacctgtcttcaagctcactgattctttattctgctttattaattctgctgttaagagattctggtgcattcctcaatatgtaaattgcacttttcaacttcagaatttctgtttgattcttctaaattatttcaatcttgtcgttcaatttatctaataccaatctgaattccttctctgtgttatcttgaatttctctgagtttccttaaaacagctattttgaattctctgtctgaaaagtcacaaatctctgtttctccaggaggttactggtgccttatttagttcatttggtaaggccatatttttcttttgggtattcattagtgtctgggcattgaagagttaagcatatattgtagtctttgcagtctgggcttgtttgtaactattcttcgtgtcaagactttacgggtatttcaagaaacctgggtgttgtgacctaagttttttgtcattgcagccatatttgcatgagggagcaccctaagcccagtaacgctgtggttcttatagactcatagaggtaccaccttggttgtcttggataagatgtggaagaattctctggattaccagcagagagtattgctttcttttcttactttctcccaaacaaatggagtctctctctgtgctgagctgccggagctgtgggaggggtgacacaagcacacctgtggccaccaccactgggagtgtgctggatcagatctgaagccaacacaggactgggtcttatccaaggcctgcggtaatcactgcctggtgaccacttatgttcactcaaggtactgggtctctacaatcaacaggtggcaaagcccagccagccttgtgtccttcctttcagggcagagagttcccccagccctggacaggtctagcggtgccatcttggagctagtgcctggggttggaaaccttagggatctatctgatgctgtaatctactgtggctcagctggcgtaaaaacctcaagataaagttcttatgactcttccctcccatttccacaagcagaggcgtctctccccatggccaccatcacccaaggcctgtggcaagaactgcccagctgtcactgatgttcactcttcagtcagcttttagtgaatgattctcttcctgggactctcccttcagggaagtgggctcccctctgacccagggaaggtccaaaaataccatgcaagagccaagacctggaaatggggaccccaagaacgtgtctgatgccttacaccactgtggctgcactgggtacctaagctgcaaggcaaagtcccctttactcttccctctgtttttctcaagcagaaggagtctctccacatatccaccacagctgggattgtgctgggtcatatctgaagctagcacacatctaagtctcatccaaggcccacagtgagtattgcccgactaccactgctgattatttaaagtcgaagggctcttcagtcatcagatgattaatcctgccaggactggatccttcccttcaaggcagagggttcccttctgacccagggtatgtctagaaatgttttccaggagcaagggcctggaatgggagcctcagaactctgcctggcaccctcttctactgtggctgagctggtgtccaagttgcaagacaaagtccactttactgtcccccccctttcctcaagcagagggaaggagtctctctcagagctgtgagctacttccctggggttaggggaagggtgatgcaagcacttctttggccaccccagttggtgtttcacagggtcatgtacccccaagtccactggctccaagtccagcacagtaccaggacttttccaggaattgcagtctttgtggcctagactacctctccagtttatatgggactcaagagcattttccctgtggtggcaaggcttgctagaagtgaggttcctattgttgagatgggtgattcccctctggctaggctgttctaaatgctccctctgtggacaacagctgagttctgtctggtgttgctttccaccctgacagggcagcactaacttccaagacaaagtcccataatcactacagtcttcctcccctaagtgcacagattctgattctctgtctacaccacatggctgctgccagggggtggggaaggggtagcatcggcaattcaagacggtctttgctatcttcttcagtgcttctttcagtgatacgaagctaaaaccaggtactgtgattaatcacctgatttttgattctcataaaggtgcttttttctgtaggtagttgttcaatttggtgtttctgtggggagaatgattggtggaatcttcaatcgagacatcttgctccacctcctcctcctattcctttaatctttaaaccaaatcagacaaatcaatttttaaataaatttaaatgaatcatatacattgatataacagattcctgttgtactagttttcaatcactgagtaacaaattactgcacacataatggcttaaaacaataccaatttatgatctcactattatgtagttataaggtcaggaatggagtgactgaattctctgttcactgttgagctggttatgttttcatttgaagatcagggtactcctccaaactcattcacattgttggcagagttcagttccttaatgggtatctgctaaggtgtcactttcgtctctttaagggtcctctaggtcccttgccacatgaccctctttctcttcaaagacagcaatggggaacttcctgcatatcaaatacccattctcaaatttgaaactcttctttacgaacagagctcaactacctaggttaagcccactgaggataatctgcccttattaaggtcagctgtgccaggtatcataacccagtcatggaagagactattccatcacattcacaaagcctgtccaccatcaatggaggggtttatacagaggtgcacactgaaaggcgggtataatgggaacatcttagaattatgcctagcacagttgtctttacttttgtaatcttactttacaatgtatttggccctcttaatttttttctaaagaaattttactttattaaaaacctttatactataaagatagtttgaacagtggtcaagagtacgatgatcaagggcataattttagagccattatttagacttaaatcatagctcttactacttatgtgaaatggggcaagttatttaaccactcttgcctcagtgtctcatctgtaaatgagaatagtattacctgctccatagggctgttttgatgactaagtgaattaatatgcacaagacacacacaatacagtccaaaagaataacagttattaagtgttagctgttagtatttatctttcacagttacctggaagatattaattctgttttgtaatctactagatttcagttatacactgaagctatgtttatctagctacccatacatgcatttgctattatggatgtcctagtctttattaatattctattgcattaatattaacatttttattaatagaattaatatcaatgttggtattctattttatatcatggctctatgacagaaaaattgaagaaagtggaggtgcctgcaaagttgtctatacagaaaggagaggcaaagggaatacaaactcctgagatgagagatggctagatgtgtcctgagcaatagcaaatttgtccagtttgtggctggaagtgaacaaggagggagtggtaagagataagatcagagagagatcttatttgtctagatcatgtagggtcttgtactttagttttcactcagaggaagctagaaagccattgaaggttttaaagcaaacatgacgtaatctgtattttgttttaaaaagaaaacgatcattactgtatcacactacattgaaacaaaggtaagagaagcagcccagatagttgaagtggatcatgacagtagcttagactagagtagtagatatgggggtagttagaattagattatcttgaactattagattctggatatttgaagaaaaagttgagagtatttatagttagttgtatatagttatgaggaaaagcaagaattaagttatgcctataaatgttttgatctcagaaatcagaaaaaaaatagaattgccatttactgacatataggactatgagaggaaaagatatggaagagatcaagagtcagttttaaacatgttgcctcttagttgcctagctgaagatgttaagaaaacaatttgggaggctgaggcagaagaatggcgtgaacccgggaggcagagcttgcagtgagccgagatcccgccactgcactccagcctgggcgacagagcgagactccgtctcaaaaaaaaaaaaaaaaaaaaaaaaaaagaaaacaatttgaacatattcatttagagttcacaagtcaggtttggcttggtgatgcaagttagcaatttttcaggagattgacagtatttgtggttatgagtttacatgagatctcttagggagtgaacatagataaagaggacatgagtacaggaaaagagtcctaaggaatatcaatgttgcagataatgaaggaagagagaaagaaaggggacaaatgcgggagttatgcctctgagtagacaataagtggatggtatcggtgaatagtgcatgatatccagtaaactcaggaacatctgagtttagataggagaattaacagttcattatactgctggacaaaattcctacccactggggtaggttgttcccataacacttgggaatagagtggggaagagagagagagaaagagagagatgagattggaacagagggtgggagagagagattgggagaggagggaaagggaggagggagagagaatatgaacaagtagtaaattagggatggccccatgtgtttcaaatgtgaaattgtaatagaaaatattgttatattttgaatttttatgtgttatgatacaggatttggccaacagtaacccatggtcccattctggacagctgcttgtttttgtaaatagttttattaaaatgcagtggcactcattcttttatgcattgtctagggctgctttcatcctgcagcagaattcagtagttgcaataaagaccatatgcaaaggaacaaaactggacccttgctttcaccacatacaaacgttaacttaagagggattaaagatgtaaatgtaagacctcaaactacaagaatcctagaagaacacctagtgaacatcattctggacatcggccttgggaaataatttatgactaagtcctcaaaagcaattgtaataaaaattaaaactgaaaaatgaaacctaattaaactcaagagcttcagcacagcaaaataaactattaagagagtaaaaatataccctacagactgagagaaaatattcacaaactgtgcatccaacaaaggaccaatatccagagtctgtaaagaatttaagcaattgaacaagcaaaaaaaataataatcccattaaaaattgggcaatagacatgaacaaacactcctcaaaggaagactggcaagtggtcaataaacatataaaacatgcccaacaccactaatcatcagagaaatgtatttcaaaatcacagtgagataccatctcacaccagtcagaatgactttatcaaaaagtcaaaaaacaacaggtgttggccaggctaaggagaaaagggaatgcttatacactgttggtgggaatgtaaattagttccactactgtggaaagcagtttggagacttctcaaagaacttacaacagaattactctctgacccagcaatcccattactgggtatatatacaaaagaaaataaattattctactaaaatgacacgtgcactcatacattcatcacggcactttcacaatagtaaagacatggaatcaacctaggtgcccattgttggtggattgaatgaagaaaatctggtacatatacaccatgaattactaagtagccataaaaaaagaataaattacgtcctttgcagtaacatggatgtagctggaggtcattatcctaaggaaattaacacaggaacagaaaaccaaatactgtgccttttcacttataagcgggagctaaacattgagtacttatatacataaatatggcaacaatagacacttcgggcttctcgaattgggagggagggaggggttgagtactatgctcactacctgagtgatggatcatttttaccccaaccctcagcatcacacaatatacctacataacaagcctgcacatgtatccctgaatctaaaacaaaagttgagaatacaattatccattcatctgtttatgacatttgggttgtttctacatcttggctgttgtgaatattgatgcggcttcagatgtctctttaagatcctgatttcaattcttttggatggatattcagaagtgtgatgctagatcatatggtagtggtaattctactaatttttttgagaaaactccatatattgtgttttcttctattttcacactgaaatgtttgttgactactgtgatagaaaaccaaggctgtcagagtataaggtaatagaagattgttgtttggtagcatattctcagagaagagcaagtccccataattttgccaaatgtgctctggggttaggcctgtccaatcctgatgcgcttcacccattgaacaattcatttcattattcaatcatgtaaatggaacattaaaaaaactggtcactttttttccttttaaaattattgtcctcctctgattcatttattttacaattaactattgaacacttagcatgcaggaggaccgtttttctaaccacagaggaatagtaaactagacaaaaatcttcatccccagaggagcttatgttctacacctgtagtgctcatgtcttgaaattttacaactactaacttaaaacttttgctaggggactctgaagaaaatgacagcttgagtgtttatcaactcttctactcccaatcatttgtctgtctaaagagatagcatgtattctctgccactcttagaggtgattagcctttgtgtacttgtgatttccctgctggagaaaagtcatgctaacctgcttgtgcagagtcctgggaaggtcgactatgtcttgctagaccttgaggacttgcaggaaaattgaaagctgaaagactactgcctcataagcttggtaagtcctaggcagatcctcagtagttgattcctggtcagcagttttgttttataaaaattttgatatgtacaccagtaaaagacgtatatagaaacatgagacaagaatagtaacatcagagataaattagatggtttttctaaggcagcaagtacatatatgtaaaatatcacctcaaagagcacgtgtaaagaaagaaactagaaggcccaggcaggaggattgcttgaggccgcgagtttgagaccagcctgagaaacatagcaagacctccccttcacaaaaattttaaaagttagctgagtctgttggtgcacacccgtagtcccagatactcagaaagctgggttgggaggattgcttgagcccaggagtttgaggctgcagtgagctaagatcacgccactgtatgccagcgtgggagacaaaacaagactctgtccccaccgccccctccaaaaaaaagaaagaaaagaaaaagaaatcaactaacagattcaaggtgtcattgagaggaactatgtgtggagtagtcaggcatatttatgacttgagaaggtatattggaaaagtagttaaatttgaatgagatttagggagagcagtttaataaagaattgtgtttagctgaatagaaccttaaaatgagaacaatttaatagagttaaattaaatttcaagataaaagtttacatactttatgcaagtacctcaaacctggacaaagttgtaatgtcaggaattagccacaaacatttcttctttgattgaaatttaaggtactttcaacacacttgcttcactcttaatatttgattcaaattatgtttttcataattttatataatgccaaatcaactaaagcagattttactcttacaaatcatgtacacatatgtataataatgagactgcatggagtccagataaaaattacattttcttatgcactcacaaaataaggaggtttgatccctgttttggaaatgtccaccaaataatacaattttctctggggactttagaaataggccaatctaatgaaaaagaaaagacacattgaaatgcagaacatgttcttcttgaaaatattgatgtattaaatatttatgcaaacatattaaattggcaagtgtatgaaaacattattacatattcatcaccttcacatttcatctttttgagaacttctttcctataaaactaaaatggaagactaaaagttttccaaagccacatttttcgaattaataacattagatagtttttcttcagtttatattaattcacataaataacaaaattaatgttggaactggaaaaggctaataatttattcaaaatagaagcactaaagtgctgtttcatcattagcctttcttcctaaaacctgaattggagcttccttttatgaaagatgctcccttagagtgaatattcactttgaaaaataaatgagctcttttaggtcatggagttatttaccaaacaactggctttgtaactactccaaatgtcataagagaattaatgcatttccaaatttctaacttctcccagagtgtaataaatctttgttgactctaaaattttatgatctttggaaagtgtcatttaaattaaaatttaaattgattatactatcctctaattaaagtcagaaagttgaaatgattttatatatgctctaaaagcactcatgtttaatataatctgatttgttatggtgatattgtgttctgcattcaaagctttttctacttccctttcctgctaaattctttccccatttctttcatcttcttcttacctcattatttatttgattgaaacatactcatcactattttattcttttatcttcctatcttttcacccctctgaccatttttcaccggcttgtcttcctttctcgcttgcaccactctccttttgttcacccttgttgatattttttaattttataatactttagttttaatttttgtggttacatagtacgtgtacatatttatgaggtacatgagatgttttgatacaggcatgcaatgagtaataatcacatcagggtaaatggggtattcatctcctaaagcatttatcctttgtgttacaaacaatataattatactcttttatttattttaaaatgcacaattaaattattattgactgtagtcatcctgttatgctatcaaatactaggccttattcattcattctatttttttgtacccattaaccatccccacttccccctcagctctccactaccctttcctgcctctgataactatccttcagtcatttacaacaacatggatgaaactggaggtcattatgttaagtgaaattagccaggcacaaaaagacaaacctctttgatgttttaaagattgttgtgttaattgttttttctcactttgagtcctcatgatctctgttttaatagtttgttcacattaacaaccctggggtggggtagcaagttcttggtgtttactctacttaatttaacttggctattcctatcttacagcctggtaagaaaaatccacatcgtgacacggaagagatggaggaagaagagaaaacaaaaggtcagagatgtagccctacatagctgattttaaaaggaacttaaaattttactttggctaaaattgacctctcctgtaatttaatccaaacctctattgcttgtgtgtggccaagttcagtagtctttggagtctcacttctctaattatccaaatgcatttgttgaagccccatcccctgcctcctccaaatcccttaataggtttgattctgctcactgctcattgctattttcatggtgccgctgaattccgctctccttctctgtttctagccttttcaacattgctttctcctctcatccctggcatgaaacacagatgctggttattcaatctctaaagcactgttcttttaagaataaacttttactgaagaatgggggataaaagatggagcgtaagctcagaacagcacagggagaaaatgtacaagtaaaactaagttatttagtttagagcttcttggtcagaccctccttagtcctgcttgccaatttgtgctagattatttttttcctggtgactgtttcccgcacctctcctccccattcagggaccccaaagcatgttcttcagtgaccaggaaaatattttatattcttaatacttcattatggagaaaaatttatttcattttgtataaccactgtgtgttagtttcccatggcttccttaacaacttactacaaactgggtggcttaaagcaacagaaatttatttttctcagttttggaggccagaaatctgaaatcaaggtgtcaggaagaccatgctcttttcagaggctctagagaagattcatttttctgcctccctccagcttcttgtggctccaggcgttctttgattctccttggcttgtggctgcatcactgatttccgcttccgtgttcatgtggctcttcttccgcgtgtcttctcctttctcttacaaggacacttcgttgcattcagggcccactcaggtaattcaggatgatctcatgccaagacccctaatctaattacatctacaaagatcccttatccaagtaaggtcaccttcacgggttctgggaattaggatttaggcatatcttttggggagccatcattcaatgcacgacataatctaaacagactccagttttctcagctttaacagagacaatcaatcaaataagtttttgatttaatttaaaaataaaaacagtatttctgtctctcagaataattctgcagcccagttcttagagcaaattacagttagatttaaaagaatgcttttcttctcattttaaagatttctctttaaaaattgttaaaatgacctaacattttaaaagacggaaaagtaattgtaatatcaaaaacttaacacaactacatatttatacaaatgcctttataatctttgtgtatatgtgtgtatatatacatgtgaatgtataaatacatacttgtaatcatgatgtacttaacaactgcagattgtgtttaatcttagcatattaaataagttttttcaatgttttaacgtatgttttaatttaccactttttaattttttaatcttaatgatttaagaaagtattagtcattgtagaaaatacaaataaactaaaagaaaaatgaatcacctgaaattcttttaaaaaagaaagccaatctggagacacatacatctgttttgttttgttttgttttgttttttgagacggagtctcgctctgtggccagccgggagtgcagtggagcgatctcagctaactgcaggctccctctcctgggttcaagtgattctcttgcttcagcctcttgagtagctggtattacaggcatgcggccccacacccagataatttttgtatttttagtagagacggggtttcaccatgttggccaggatggtctcaatctcctgaccttgtgatccacctgcctcggcctcccaaagtactgggattacaggcgtgagccactgcacccagcctctgtattttttaatttaattatatcttcatgtttgtatgaatctatatctgtagctgtatctacatttatttagttttggctataaccccatttcaggaactagttgactaaaaaataaacttctattgtttttgaattattacatattttgtggtcttttaaaaagtactgcaacctcctctatgaatgaatacacttgtttttataagttttgaaacatattgttgaatgacatttctcaaagcctaagcacagatgataatccctactgcttcttaaccaagattataatgacaatcttagaatcaaatgttatcaattttaatatttattagagaatgtctgacaacactttctagagattctcttattttatcatgttgccaattttcctaaaaagtgttaagtgagattgttaaggctacaatggatgcaaataatgttaatactataatgaatgcaaaattattaatttaaccattcttccatcattaaaccttgtatatatttctaattttttattgttatgtttatacatattgatttctctgcagctaaattattcagttacataaatttcccagaaatgtgggtattcagggaaattgtggaaataaatctagtcttcatacagattgcagtttgccttttataagggttatatgaagacagtttcatcagagtataagagtaaaccggttttacctcaagttcattatcattgttgtattttgatattaacatcagtatttttaatataaaagtaatagaattccaccataagattagtttaattgcattgcttctgtctcagaattgaagtttatataagttcctaaatagctttaaactcatttaatgtaatttatttttgtctacttatttttgggaggcttaatttgaataaattgtgtttttattgcagatagatcgtccctctggtgatctttatctatttaaatttcctatgatttgtttttactcaatttattagtctataaagaatttagattgatataaggtcaatttccacagattgctaattaataatctttatttattagtagtccttctctgttactttatgttgcctatgtctaaaaaattttctatagttttgttcaggcattttcactatgttctatttatcatcacacttatttttgttctaacagcatgctgttttgattatcactgttttaaaatgtgacttgatatctggcagagtcggcagccccacctcacagttatgctattaaacatttaaaaaataatatctttttttttgcattttaaaaagttttgtgaattggcaagaaaataattaaggactattttaatgggtagtgtgccaaccccacagagcaacttatgtgagagtacctttaaaatatattagtcaatagtcaatatttgcattatagaagaatcagaaaatatccaaggagtattttcatactaaaacaggtgttttcaaatgggaactaagaaatatgtgattatttattggttaagataaaatgaaaattaatattactgtactatattaggggctttttttgtttttaaattcgaatatacaggtattttgtaggaattttggcttacttgaaatatcaccggatgtcaggctatcatccctgaaaattgtatgggttttatattctgccattcttttaacataggagtctagcaacctacaacaaaagataaaatatcttacaaagctcaggagttaaagggaaatgttctaatattgcaagaagtcaggaaatacagctttgttttggaggaatggaactacatttatatctggaagttaattagatattgtgacttataaccaatatgatctaattcataatgaaagaattttgcaaaaaaaaaaaaagatttaaattttcataggatattttttgtgttggcgatttgcctgtgtagttgatttgcatgaagcatgattaatgataattaaggaaatagttttaccaggtagaaggagatgaaaaattatcctcataaaataacacttcacagggtaagcatttcaacattaaaaaatgattcattgcgattttgtgacattaaacaactatgtgaactcgtaataagataaacttattagccagtgtttgttaatttgatttgtttaccccagtcttgagttttctaggacaaaggcttaacgttccacttctttctacaaactgcacaaggtcatgaggcaaattaccagatcaagacaatttgacaagacaaatgcaaacattataaatcagttcatctatgagtaattgaagatgtgaaactaaacatagtaaaaattcatgtttgttgttgttaaattgctagattacaatctcagtttctttactttcaaagggtgaatgcttttgagaaaatcaaatccattttacaactcacacataatgttttatgtggctgacagcataagtgtttttataagtctcccatatagtctaaaatataaaagccttgggtcatgtgatatgaatagttaatatatgagtttatatttagaatacaaaagatagtataataaatgctattaactcaaaataatattgctaaaattatagaacttatatattgaatgaatgtattataaagctcatttatttcaactttggttcttgacacatgtacagtggtttaatacagcctttattttggctgagtggctatggattttttataattataagaagagaactgtggcatattcagtatttttacttgtaataagggtgggctttatgggcatgccaccaatgtggttgcccaggaatccacgctctgaagggacccacactttaatgttctgctattactttcttgaaattcttaataatattttaattaaagaaacctccttttcatttcgcattgggctcctaaaattatatagctcatcctgtctgtaaccaaatactatttctgagaccctcttgtgttacagttccctttaagcaaaagactacagtcctctgatatttggggggttttcttcttgttttttttttttatgtatactttcttttccttaaagttcaaaaagagaactcatttaggggcatactggcatgtgtgaattgttttatttttctgatcacatgacttttggttttaggctacaactcttgcacttttcttcctcttagaaaatgtattaataagataatgttgtaaatgctgttgcaactgcaagctgcattacgtggcctcatattttcttccactgacaaaaaagtatgtataacatagtaagtacttttatctccttcacctggattcagtgattattaacatttacaccatttgctttgtctctctctcacacacatagacacatttttcttcggattcatttgaaagtaaattacaagtattttgacatttcactccaaaatatttcagcttgtatctcctaagaaaattctcctgcatgacctcagtgccatccaaaatatttaaaattgataaaatatacctaatattatttcaattcaaatttctccaattgtccccaaatattttttattgatttaaaaaacctctaggatccaacccagaattatgcattacctttgattcacatgtctctagtttaataaaaaatatctatacttgtgatttttcctgaagaggatgttaagcttgatgaaggtaggtatattttctttttctccaatgtggtgtgtggaattgagggaaagacaaaaaagaaaattttctgtctgctcgtcttgagaagctataagccttgtattatcttcaaggtaataagaacagattgtataatagccccagtgtactgaaatttattttaaatgtgagaagtatattcaattaggttgtgttttaaactaagtgtggcatctggaaatcagaaattataaatttggaatatacactttgtctttaaatgaatggttccttcccttgaatatgacatgggaagggtccaggaaaagtagaagagggtccaagccgcagtgaatgataccgccatccttccagacttcactgggtttctctgagccagcagacacggtggtgatcacattgcttggcatttgctgggagctgagccctcttctctctccatggttttgtcaagctggcaccataactttgcaaacggtgaaatgagaacacataagtgctgtgtaaacagcagggactcctgtttttctttctttatcattctgtcatctgaagtctttctctacctcctgtgcttatggaattcttctttgaggagagggaggcgtgtggaatgggattgggtgctctactattggagatttatagataggtcttatttgcttggttgtgaatccatgaattattttggaaaggcagtgtctttctcttgatgactcagagaaacatcagtcaggatcaatggcttcttgatgatgtaggcttaatgaatccaaatcattgaactgaaacttttcttttaaaatttcaaggcatataaactcatgaaatcagttttgtttcttatcatttgccatgtgttctcagctatcactgtacaactttactgtctgacttaactgatatgcttttgcaaaataagtaattgaaactaagtctgagaaaacctcatcctaaattcttttcttgactttgattaaatcatcatccctgtctttgttacttgatttgctagggggcagtactaaaaatattgcatagggacctcaggactctacaggtccctcttttgcttagggacctcagtactgtacaggcactctcactccactttttaatcctgttgggttcatttcaggagtacacatcactatcttaaggattttcaaattgctgctaaaaatgccttctctttttcttggtccctccctctctcccttctttctttctctccttccttcctttcttagttctatttggaacctaaactgagttagacattaggcaattgcaaaacattgttttttcttatttcaaagttttaaacctctgttcagttaaatattagggtaaaacagaacagatctatcaaaaatgaaaaatggtcgctatgaagaaagagtgcaatcagtaagctaataaggcagcctagagtgaaagaatttagaactgttagggaaaaacaaaaactagattaaaatatgtagtttctgaagactttctcaaaaaagtattttgttcaattaagttattttaaaattttcatagcttttcatattgtagtctcttttatagatacatctgacaaaacttttaaaacactgaactattttggtttccagtgctgtgtagtccaggtcaagaatggcagtggctgggtcctgaatttctggcttgctggcttggtcccagctacagctgaggagatctatgtccagtagtaccccggggaagagggctcagcttacatgtggaagggcctcacctatctgttgcactttcctaggggaaagtgagcatgcttaatactttcctgaagcagccctgtgaagaactctgagatccaggaacattacctaccctatctctgcatcagatctaggctctttccctggtgagactgtaaccaaattctattccataacccttatatgaatctgcttctgattggctgtaaaggggatagcattgatttggaccacgactttctatatgggctagaaaagtatatgggaccttgtgcccattttctttacttgtatcaagtggtgaccagtatacagatggtcccccacttaggatggtttgacttaaaatctttttactttcaaatgtataatattatgaaagtgataccattaagtagaaactgtgctttgaacattcatacacttattctggtctttgttttcagaacagtattcaataaattacatgatacagccaatactttattattaaataggcatcatattagatgattttgctctactctaggctaatgcaagtgttccgagcacatgtaaggtaggccagactaggctatgtctggtaagtcaggtgtgttacatgcatttttgacttacaatattttcaatttaggatgagtttctcaggccataaccccattgtaagttaagtagtatctgtactgatcttccatctctttgcttgtggcaagagatggcataaataaatacataaacttagattggtcatgaggaaataaaacaaaacaaacaccagagaatcaggtagtgggacatgaactctattctcagcttgaatgactctaagcatattgttccttctttgtgccttgtttcttttgttcaacttcatgtccatgaaattcattcattttcttttgtgtagcagttacttgcttttattgttatctaatattttactatatgaatagaccacagtttctatccatgctatggttgagggacatttggattgtttccattttgaggtttctatgaatacttcttcaataaacattcttatatgtgtattttggtgatcacctgcatgcacacatggcatggaattgctgggtcatagggtatatgagtattcagctctaggagatgttgtcaacagttttctggaatacttgcactaatctcagtacatgctatatgaaagtttaaattatttttcatccttgccaacacttagtactgttagtctctttaattgtagccattctgttggatgggtcttgctatctcattgactcttcagtgtacctctcaaagagtttttatacagacacacacacacacccccaagataaacatacagagcattgacagcattcaagaacactctcttatatcttcctagtcagtatagccctatctcttcctagtcaatataccccacccaagaaataacagctatcccaacttccatcaacataaattatttttgtctgttcttgaattgtatgtaaatgaaatgacagtttgtagccatttgtgtctcaattcttttgcttatttttatgtctaggatattaatatgtgttaagatatgaacattgcaagcaagttttattttatattgctgtgtaatattcccttgattgatatattacattttatttttcccctcttttgatcatggacacttgcattgttccaaattttggctattgggaataaagcagctataaatattcctatgtgtgcctttagtgggtataaacactcatttatgtttactgtttttctaggaaaaggattgctggtcatggaatagataatataagtttagctttactagatattgccaagcagtttctcaaatgagtttttccaacttaagtattttttctataacagcaattaatttattgagaaaagaggaccaggaagatttcagtttatttttaacatttcattcttaattttattttatttaaatttacaaaattgtatatacttgttgtatacaacataatattttgaaatagaaatacattatggaatgctaaaaggagctaattaatatatgcattacctcagttatcatttttgtggtaagaatatttaaaacccattctcagcatttgtcaatactaaaatttgaaattagatccttatgtcatattatataaaaaaaaatcagattagtaaatgtaagacccaaaactataatataaaactaccagaagaaaacgtaagggaaaagctctgtggcactgatatggggaatgatttttgtggctataacccccaaagcacaggcaacaagtaaatgggcaaatgggattacattaaactaaaatgcttctgaacagcaaaggaaataattaaaaagtaaagagacaacctatggaatgagagaaatatttgcaaaccgtatgtctgataaaaacttaatatccaaaatatataaggaattcaacttaataggaaaaaaacccgaataacttgattaaaaattggcaaagtatttgaatagacatttctcaaaagaagacatacaaataatcaacaggtagatttataaaaggctttaccttactaatcatcagggaaatgcaaattaaaaccaccatgagatatcacctacacctattagaatgactattaacaaaaaaggcataagataacaagtgttggggaggatgtgaagaaaaggtacactgttggcgagaatggaaattagtacagccactatagaaaacagcatggagattcctcaaagaattaaaaatagagctaccatatgatgcagcaatcccagtcctgggtatatacatccaaaggcaataaaatcagtatgttaaagaggtaactgcactcacatgtttattgcattattcacagtaaccaagaaattgaatcaacttaagtgtctgtcagtggatgaatggataaagaaaatgtgttacacatacacagtggaatattattcagccataataaagaaggaaattctgtcatttgtgacaacatggataaatctggaagacattatgttaagggaaataagctaggcacaggacaaataccacgtgatgtcactaacatgtggaatctaaaaatgttgatctcataaaagtagagagtagaaaagtggtgaccagaggctggagtggtagtggttgtgggcagttggtgagatgttggtcaaaggatacagagttttagataggaggactaacttcaagagatctatcatacagcatgtttttccaatttaaactcccaccagcaatgtgagataattccagatcctggtcatcattttgtagtttggtctttttagttttaatcattctgaagggtgggttgagatttgtcattgctttttaaatttgcatttctctgatgaaaaaatatattgagcatcttttcttatgcttcatattaagagtttcaatatcctcttttgtgaagtgcctttgaaattcttcttttcttttttaatgtttttctttgttattggtttgtaggagttctttatattcaagatataagttctttatattcaaggcataaattctttattgtatctctatattgtctgcatgttttcccagtgcagtttgctttttcatttgtgatcaaaagaaaaaccacagtataaaaaaaaaagatgctctgttagttaccagtatttaaatattaggaggatttatagaaaaatctggatttttaatttcttttaaagtagtaggaggatcctgcaacattttgcttgagatctcatataccttaggctgcatggtagctactcccatgagatgcctactatggtccctgttgcttcctacaccaacctacttcacaggttcataataccagcccagttctgttggtgcctagtgtgagagcctgatctaaggtctcccttttttaaatttatgagctgtacctaccagagttttttgcctgacaggttcaatagtttaagggacaacgaaggtcccttttggatgatacatacttaagaatgccaaatctctgactaccaagtaataaaaactttaatgtaattgaatgcatagtttttacaataattcattttttaagtggcaggatataaagcatcatatctgggaggagaagttgagactttaaatagagaaagtgagaatttaataatagtggaattagcttaaatagagtttaaatagtagaatcagtggaatttgattagatgtttcataggatgcagatgtaaaaaggcaaaaatatcataacctaaatttcagaatttgtcctatatatgtgtgttcatatatatacatatatgtatatatacacacatatatatccccatattgctttgggtgttggaaccatagaagtggacataatagagaaattctctgctttcatggacttgtaattcaaaaataataagtcaatacataaatgtacaagcaaatattaaaatatacagtagtttaagctgctaaacaagtttttatagtaatcaagacagtatgatatttgtgaaagaatagacaaatagatcaattgaattgaatacagcccagaaatagctcacacaaatgcagtcaattgatcttggacaaaagaggaaaggcagtttaatggagaaagtatagtcttttcaacaaatggtactggatcaacgtgaaaaaaattgaaaaagaatctagacacagactttccacatttataaaatttaactcaaaaaggataatagactttgccctttacttttaagggcaaaaccataagaccctagaagaaaatacagagaaaaatctagttggccttgggtctggtaatgactttttaaatagagcactgaaaacatgattcaggaaagagaaaattggtaagttgaactcaaattaaaaatatctgctctgcaaaagacacagttgaaagaatgaaaagatcaaccatggacgtggagaaaataattgcaaaacatatctgataaaggattggtatctaaaatataagaactcttaaaagttagcaacagtgaaacaaacaacttaattaaaaatgggcaaatgacatgaacagataattcagcaaaaaagatatatagatggcaaataagcatattgagatgttcaacatcataagtcattaggaaattgtgaattaaaacaacagtgcaatgctattacatatccatttaaattgtcaaaatccaaaacactgacaacaataaatgttgatgagcacatggaacaaaaggaactctcatccactattggtgggattgaaatatggcacagtcacattgggagacaatttggcaatattttacaaaactaaacctaagattcagcaattgtatttcttagcatttagccaaataagttgaaaacttatgtccacacaaaaactagcatatgaatgttttatagcagctctattcataattgccataacttcaaagtgaccaaaatattaatcagtaggtaaatagataaactgtggtgcattagtttcttagggatgctgtaacaaagtatcacaaattgggtgccttaaacaacagaaattaattgtaacacaattctggaggctagaagtctgaaatcaaggtattggcagggttggttcttctgaaggataatttgttccttgtctctttcctaacatctgatggtttgctagcaatcttctggcattctttggttcatggcattggctcatggcataaggactacaatcttcgcatgacattctccttgtgcctctgtctctgcattcaaatccttcccaaacctttttttttttttttttttggataatgacaagagtcattttggattagggtccaccccaatgacatcacttcaacttgatcatctgcaaaaaccatatttccaaataaggtagcattcacaggtgataaggactttgccattttaggtggggggtgcagaattcaacccctaacatagtggaatattattcattaacaaaaattaaggagatagtcaagccactaaaaagatacggaagaaacttaaatgtctgttgctgaatcaaagaggccagtgtgacagagctaactattgtatgattccacctacacaacattcttgaacaggtaaaattaaggaaagagtagaaagatcagtggttgccaaggattcagagggagacagggaaggatgaacagatggagcacagggaatattagtgctgtgaaactattctgtatgatactgtaatggttaatacgtgttgttatacatttgtcaaaacctgtagacaaagagtgaactctaatgtaaaccatgaacttttgttcataatattatatcaacattgggtcttcaattgtaacaatgtactacataaatgcaagatgttaataatagaaaaacctgtctgctggagcagtaaggggatataggatctctctgtactttctgttcaatttttctgcaaacctaaaactgctctaaaaaataaagtctattaatttatttaacaacaacaaaaaaaagttccaggttctaagtagctccattagcttcactggtcagaaggaagggcctctctgaagagacaacctttatatctgacctgaaggacaagaatatgtttcccttgtgacatgcagataggaggatttctagtaaaaagagagctggaaaagggactctgcagtgaaaagctgcatgtgcctgaggaacactgtgaggagcacagggatttcccaggggaaggcagaagaaggaggcagacagggacttgatagaacaggacttttaaaacagagtatagtttggattttattctgagtgtgatatgaaatcattggatggctaaatagcgatgtactaggatataatatattaaaataaatatcactatggcctttggatataaagaataaattgtgtatgggggcaacactggaggcaggaagactggttaggcagatattgcaatggcccaagcagaagataatactggtttggactaaggtggaggcaggggatatagaggtgtggggtgtatttaagatatgttgataaaggtaatagaagagaggacttctcactgtgtcaatcatctatgacacagctatgaatctggaaatatatggaaatatcaacttggttgcaggctgaagtccatgccctttgccattcacatcctcttccatggaatgaggactcatcagataaaatattgttttaaataaatggaccttgtgaaattgcacatgatatttgcttttcataatgtttgctgtaatagaattttactcgtatctaaaactcatttggcatagacatatttccaattttctttcacttttcactgaaaatttttaattactggagttggaaagaaagtatctcttttagtagagagaaaagttaatacaactgagcaacttgatatctttagcaactatgtaaataaatatacacatctttcttttatttacatttggtgagccacatctaaaatatatgctagcaaaactggggagctgtgaaatatgacgacaccacactgatagatatcagtcacaatctggcaaggaaaagaagggagttgctttcattttctgtttgtttttagaattattcttaaaactagataaatgtgacaattgtgccaattttttgcctcaatattttaagatgaatggcaaaaattagaaagaaaaggacaatctaatgcttaaaatatggcaaatgaacaaattctgtattatccatttctaaaggaaaagtatttcgaaatttaaaaatttttaagaaattcagcaaaattacagtagtctttgaaacattactataaaaagtagattattttgtttcctctgggaaaaactcaaatagacacaggataatggtctaatgaacaagaatgtcaggatagctaacaagtactttgaataagatataaaacagaatagtgtgtttgaattttatattttgattactcttatccatccttccattttataaaaatatggctgattcgtaaaaataattaagcagtattaggaagtatatttgctcaatgaagaagacatagtacccttgggctgttatttacagaaatgacatcattcatctttctaatccattctaagttgcttatgcgttggtcctcaatgctgtttgctacctacatttatttatccagagtgaaatagtaactatcaactgagccacactatcttcttcaaaaattccactttattcattttttggtcaatatttcacctatttttgaagttttactatttgcaaatacattgttttctttgtataaaatacatctaatgtctatacactagtaatattacttgttctcagcttcaggaaacactttacagctgtaagttgaacaaacactacgttgttaaacatgccattgttgtggtgttaaatacatcaatagaaaggagaagatggatctgttgcatctgctgccactgctctataaatttatttttatttcaaaagttcttaccaacaatttatttaaaataaacaattcctgagatttacattgcactatcccagtttcagtaatttttattctgaaggtttgcaaggaattggcatttttcccttatatactcagaagctttgcaaacactttaaaagactatataaaacctttaaaatgagaagtacatctatgtattttttaaataaaatattaaggatattaagccattgtaatgatgtaaacaaaaagtcaagcttttattgggtagttacaaaagttataattagattcttttttgttccttttttgcttaagaattttatgagttgcctgaataggaaaaattaaattaacagtttttttttccttttaacctgtttctgcttttgtgtcaatgtcaaccgggatgcgaatggggcattgtgggagacaggagaggacaatactggggagaattagcgcattggcggtagcctttcaattccagcgctgaagcaacagactgagaggaggtgaacctttaccttctcccaggcacagacaaggcgaggtgaggcagagatggattgcagaaccgcattaagcaaccgcggggtggaggagagtgcagggtgtctccaaaccctgggagggctatcttctcctttcagagcacatttctgcccaggtctttttattctcagtgcagctcgctccctggtggcttaaattacggtaaacgaaataaggtccgttaaaaaccacttctgagaggggtgattattgggggttttgaaagcacagaggtcttatagagaccaaaaatatgtgcctcgctaagatacagaaaggcttgtaagtgaatcttcataactctgggtacgtgcatgtatatgcacatatacgtatgcatgtctcgtttctataccttatataagttttctgcccaaaactttcctcgtccgtgcgttccctaccacggcgcatctaatctgtctgccctatttgtggctgcacagctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggcgctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggtaatgtgcgcgcgcacacacatacatacacaaacgttccaactcaacacaaacaaaaagatattgagagatagtatcctgatacaatgagtaggtggtggacatctaaaacgtataccttatccataggtatggagatacatcgtgtccgtttatacaatttattgacagactgtgacacagagaggggtgtgtatttacatgtgtattttcaattcagtcagtaggatctatagtgctacggatgtaaatacttactgaatgcagtcaactgcagggctcagaaggtagctcctctgtgctatgtcaacttacgaatctgctgatttgagcagtgtagaaagtttgagtggcacgttataatgtgcttttgtaaagtcatcagttgagattagtttaataatgctactgttactttgtgagaaaaactcaaagattttccctcaaatcattggcaaaaggaaagttataggtagtgaaaacttgattatatctaatgctcaactatgcacattctttaaggggaagtaagagaattctttatggaaatctgagttggataatttattgtataatatacaaatatattaacatgcaattaacgtgattgctttttaacttagtaaactattcaatttagttactattcagtttattcacattctttttataaaataatttcatccagattatatgagttaaatacattattaattcatttcttggtacatgctattatgttttaaggctccaaatatgtttcaagaaaatgtgtgtgaatgtgtatgtgtgtgtaatttatatatatatataataaatatatatataataaatatatatataataaatatatatatatattagttttggactactagtgactaagtatccaaacttaaagaccaacttttgaggtttcatataaaaaacagtatttaagtctgtatgatatcaagagggaaaactgaaattgcccaactttaatttttttatgtttgatattttccatcatggtttaatgcttctttagcatgaattattcaaaactgcaacatattataaaagcctttgattattaataaatgctatatgtaatttacatgagaaatctaagatcagaaagtacaggtgcccagagatatcactaggattcctcatgacaaactattccttcacatgcttttatgtactataaaaagtgggttgttgcaactgctccccccaacaactgtatacagtactgagtcagaactgttagatggaaaatactgtttgtataagtacttaacaattaaactcacagggttagcaggcacttgcagagttctagtttaataaagcccacattcagtccctctaagtagcaggtctgaatctttcccatttctaaagattctcagaattggagttcctgcagtctcagcaaaccactttaatgtttaacaactcacagtgccaggagaatctttcttacagccaacttaaatcctttaaattcttctttaagtctatttcatctagaaaacatacaatgttctgcctttctcacaggtattatttttcaacgctttggtaatctccgtgcctgtctcccttgccctccttttggttatggaaaactaaattgggtagggcattgtactgtttgtgccttaagacttctcagtataaagggagaattgcttcataatcttacacggtttagttctattcaagttggttagactatggtgttcatcttcccaaatctgtagggcttgcagaagaatttctgttacatggtcaaaaagtgtcctttctctcccactttggtcagtcatctcccaagagcctgactgacactatagagactggatgtgtgaatgtggatgggagaagacagcccattgaccacatggctgtgctggttgaccagggttcaccaggtactccccaccctcagggcactatttttattcactgctgggctggtttttactaaagtacaaattaatttactttgttatctaggatctacactttgactcactggaaggttctctccaatatttatttacacatttggatgtacttaaattacatatgcatcatttaaaaatatctaaattaaatgatatatgtactttctcaacactatttgatttacttggtcttcttttacattttattatggaatttgcatggctttttcaatatttgaatagtttctcatgtgagctgggcactgtatgaaaatttgtgtttattcattctctatcattggcaggtggttgagatgagtcttccaacaagttgaggtcctcttcccattacataacacttagcctttctccctaaggtgaagtggatcactaccttctggaccttagacccttacacacttgaaaactttcctaatctagataaatgtgtgtttgccttccttactaattaattgcaaaatatgaaactgtaaactgtggttatagatctttttttaattcagcaatacacattccccagttattttcaggttgacataactttattgatttttttcctttagtataaatgttaaactcagagatccataaaatacattcatctatttccttaaaaaaacatagctactctgactttttttttttttcaaatttagtgccaggaatgacctaaaattgacctttacatcaatgactttaattatttccactcactgaaactcagtttatttagtatagagatattcttagttgacttaactaactttcactaagatttccaatacttcaactttggtctttgccctttttatccaagtgtctctcctattacttttgctccacatttttctgttttattagaactgtttgcatgtagaacatggtcttaatattcaataaaacaattattggttaagactactttctacctctgctacagaaaggagaaagctacaatccctttttgacataataaggatttcttcttttgtagttctgatattatggatatctgatatctggatattatggataaaacatttcactttcctatagacataattcttcaattatataggtaaagtagttgtgtacatttatgttcaaatcacatgtctgtaaaatccaaacatgcaattttaagctaaaagtaaaaaagaatgattatatttatttcaaaggatttaatttagaaaacatgttgaatcattatatggaattgttgtaataaattcttaatgagttatttgagaaataaagcattttacccccaaacagtttttgcagatcagtaaactgaaaatcccagagtgaaattcagcttctatcttcaaagtgaaaacatggtaatgtcttttatctattgcatctttcttctttttagagactgtgtgtgaaaaaatagcatactgctttttaaacctaattaaaatgggaataattgagtagagatagtttatactactttaaatccagggacatattaaagaaagtaaaaaaaaaaaagaaaaatgagagaggattttatggtgcttaatgataaaagtctctatttttagaaactgtgcattttctaaattctaccacaatttatacctatccccgactctatctaaactctaaaataatatgactacatgatgactttaaaaatcattatgagatacacatatatacattatagacagaaaaatagatagatagatagatagatagatacacattgctatctgtgctcaagccaaagaagttttttatatattatgttatatagtcttctaccatcaaatatattaatggtaaaactttgttttaataattgggagcacttaggggacccagcaagccagtccacatgggctgctctgaaaagttggctgctcaatttaataattaaatttaataacttaatcagtaattaagctattcattgagaacatagtctatagattaattcagtgttcatgaacttctaagttctatcaccatgtttgaattcaataaaacaaatagcttctatgtaataagaaaaatatatttgacttgacttttagttatgtgatctgaaatagcatctcaagtttatattcgaatgtagtgccgttaatagtgagactatcattcgggatacctattgattacatgttaataataatggtagatatatattttatctgtggtacatatttagcttattattactcttttgaagtttagataaggttatatttcttaagaagtgcttattcctgggagcaccatagttagacatcctggaatatctttttctgggaatgcctattgtcttaatgcattgggtataaaggaaattttggggattgtcatcaaagtgaaaaatcagggtcgctgaatgttttatgttatcttatcttaagttgtatagctgattaaattggctaataggaggatgtggaatataaacaaacaagcattttaaatggaccaacaatctgctacagaattctcttgataaattacaaatgtatatctataaatgaaagaagttctagaagagatgaactaccttgaagatacatccatccatccagagaacttcttaaatgaggaaatgagtgcagttaaacccttgtcctttttttctaatgcctataatatctgactgtgtatattttcattatgcctaataaatacacattaaagactttcaaaattgctcttaaagtgatgcacttttcaagtgcaaaatataattatgaagacatgccctcctgtagagaagtcacctgcatcctcttcttgaattcatgaatgcataatactacctttcatgttggaattttcagacgttttcaataaagacgacttagttacaattcttataatacatgttctcttttttatgtcaagtatcatataaagcaacctcctttcttgtaattgcctttacagccatttcttctttcccctaactgatttcaataactttttagttagcacctatgctagttggtaccttccagaacctaaacaaatttgtgtttatttgacttcagaaagtttccatattaagaagacttaaataggtatttgagcgctataattttggcttttattagattacactacatttatttcataattgaaattagagggctcatataccttgattagtttcttttagatatatgactaaaatgaactctctgttttaggtttctgctccataatttggaactaaaataaaaatgaaacattttggtatcatgggtaggctaaatgtgcatgacatttaacatagaacttaactatttgtgacttaaaagaaaacataatgttagttgtaactgtgaaatttttgctgtataaagtgtatgcactaaaatacgtatttttatgtgttaagtaataacagagcttgaaatgccagttggttttaggctgtgttggaagcagacagcaagaacaataatatatatctcaaataactatcaagtgcctttcagtgtgaagttgattttttcaagatacacattgtcataattctttggtatatatgaacatattttgtataaaataatttgaataaaaattgaaataaaaatgctactttgcttgaaaatgcctttgggttataacaaatgtagtttttcataaaaattcaagtagcccttataaaatgacagctgaaaaagccttttgtagattgatttcacaaatcaggtttacttagagaataagatctggagagagaaattaaatatttgatatgttttcaagaaaaagtgtagttatagtgataatagtgatataccaatttccaagttacgtagtctctcttgttttggaagtactaaacttggaaggaaattctggaaaaataaattactttctaccttagacagcattttcagttgtagctaagacactctaaacttaattgaagataaaaaaacacaaaagagtattatggtgtttaaattggagcaggacctgtaatcccagcactttgggaggctgaggtgtgaggatcccttgaagccagagcttgaagccaggtgttctagaccaggttgggcaacaaagcaagaccacatttctataaaagaaaaaaatcagctgggctcagtggctcatacctatagtcgtagccacttggaaggctgaggaaggaggacagcttgagcccaggagctggaggctgcagtgaaccataataaggccacttcactgcagcccccaggcaacaaagggaaaccttgtctcaaaaataaataaataaaacataaaagggggttttgatttgctttttaaaatattcgctaatgatattaattttcctgagatgacactcagataacatgtattcaactaatctcttattttgttcaaatttgatatctaaattctaaacatatacttctgaagaactgataatatatttttctcttcacagaaaaggataaccatatagttgaatcattttcttttcttctttggctgggaggaagagacaaatctgtggcttagcaaagggataggaattgatgttggccttaaaagcaacatgatatacccttctctgctcatctcctgttcctagtccagctctgattctatttccaatgactctcgttatttttacatttatattttgctgttttaatgtacaaagtttctttcacatgacttagatctgttgtgaaaacaagttgggttgtaaatcaataataaaatattgaatgtccaaattaaggatgctactcaggattttgtactggacagcaatgagaatgattcatagagattattcagtttgttcatttctagcaagtataattaggactgccagttttctttttttctttgacaattggcaatttccttttggcaaattttatttcacttttgtgtgggtgtaagaggcagaatatagcttattttgaaatggatattgccagttttttcttttcttaaacaatcttcttcctctctattcttcttgccatcagtccttattcatttcattcacataattatcaagtttttcagcatctttttttggttcacacataaatgttggcatatacttctaactccagagatactagccctcgcaaatggtaagaactactctattctgtgcgctctttcacccaaccttacaagtttctcccctgttcaccatccacacgtaactttcatctttagttcagaatttacagctttccccatatctccattcagaacccacctaccagtgttcttcccctgcccttcttcccacagctattactcagcacttcacttgtcctgtgtacttctcagcaccagacaaatacagtcagcttcccctctttccactcacatatgtcccttccagttctttattttgctgtgaataattatgttctctaacgtcttccttggcaagcaaaggctatatgcattttctttttgtgaatgaaataaatgccatattccaaacaaaaatggccatggggcctctttttttaaatgacagggaggatagaggcatgccttaaattagacttgtcctattcatttgcttcatctgatatgaaaggaagaggcatggaggtggccatattacttgcattcacattctctaaaaacgttcaaaatccttgaataatattttaagtgtaggtgcatgatccagccttcacctacattttcagctttcactgtgtatccgtccacatgattctactattgtccacttatactgaagagttcttgactatgacatgttcgcagatgtttctgccattgcagacgctgttccctctaccccaaaaattttttacccttcatttgttgggccatatcttgtatattcttacagacttaactaaggagttcagtcctgcatttcctttcacaggtcaagtgcatctcttatagcctgccattacatccatcaattgccatcacatccattgaaatccttggggtaagtctgctgtcatccttatgtctgcaaatattctgccttattttactcaataaatatctgtagaatgaatgaacggaggtgtgaataaaaatgaatgatgaacaatatattattagattcttcatcattcaggacattcccactgatacatttgacaatagtgtagctggtatgaggaatattggaaatttccacctagtcattgacttcaatgtttagcttatgatttaaaaaccacttaaacttaatgaattactgtgaatacctcttctgcaatttcactgcaagaagcctccagaaaattggggctagctctacagtttagctatatatttatattgaaattagtgaaatttaaggaaatcttaagtacatatttaggcattaagaacattaactcacaaatatttggctaggcgcagtggctcacgcctttaatcctagcactttgggaggcccaggtgggcagattgcctgggctcaggagtttgagatcaacctgggcaagatggcaaaacccatctctactaaaaatacaaaaagttagctcggcatggtggcacgagcctgtaattccagctactcaggaggctgaggccggagaatcgcttgaaactgggaggcagaagttgccatgagccgagatagcaccactgcactccagcctgggtggcagagtgagactctgtctcagaaaacaaacaaacaaaacttacaaatactgatttttatgtgttcagtttctatgatatattatacctaaatgtatttctctctttgggtattacttctggccactgatagagggacaatattacatgaggatcaaaaatgaaggccctggagttaaacctcctattttcgaattctagttttgccattgactagtaattttataacttctcttaacttcagttttaacttcttcacagtgggaaacaatggttcctaatatggtgttttgagcctagtgcttgacattcattgagtgttcagtaaacattaacagtgattattactcagattgtgtgtgttgatatgtgtgcatgcgtatatacacctgatgttgtagtgggggaaaacttccaacaagttttatcaaactccaattgggataattatccttgtcttagttaatttaatgatttcaatagaaaataaatagatttcaatggaaatttaattagtataaatatgttcccttttgtcctggtggtaggtccacaaagaagatttttccatagagaattttttccccagttataattttttagaatgcagactattctactgatggattaagtggtcactgttttcatggcaatttttatcactttaagatctaccaagatcatttggtcaattgctttaggtataatttagtgtcacttatcaatccaaattgcagagtgctttattctatgtagcatttcagaacatcttttgctgaaggccacaagaaactgaagactggtatatataaattggtgtaatttgtacatgagttagttaagccgtattttttcattggtggcatatttaacagcttctgataaatgaattacaagttaggaacttgatcatttctttcctatttaggagtttataggaggtacataagaagaaggaaaaatagtgttttgtaatctttttcttttttttgaaagagagacaataattccctgaccaacgaccactgcagcctttgagatagcaacatcctggaaaagccacagtgtggttgtatcataattgttaagaatctccaattgcctgagtttatcagtcacatacttttcagcaaggttttgttagcaattgtcccttctcaggccagttaggatgggaccacagtatgtaagagaagcttggtcttcttctaaataataaattttatctaaaatatttagtcatctagggtagacatacagaaagaaagtaatactcttaggagtgaagagaatctgtttatttttatggtcagtttcttaatccaaataaactttttatcagttgttaatagatagttaaattctttgccttatttatagaatataaacattggaaagacccttagcaatctagattcttttaccaatctatatacttaaatatatcactatggtaggcagattaatgatatccccaaagatgtttatatttgagtccccaaaacctacaaatccaatatcttacatgacaaaagggactttccggttatgattgaattaaagaggatgagatgattatcctggatcacacagtggggtccaacttaatcacaagggtcataagagggaggcatgaatgtcagagagaaagctttgaggatgctatgcttctaggtctgaagttagaggaagaagtcacaagccagggaatgcaagtgacttcttgaatctggaaagggcaagtaaatggattctcccatagaggctcaagaaaaatcacagccttactaacatgttgatttgtgcccagtggagcttctgacctagaggactataagataataaattgatgttgcattaagccagtaagactgttaattcaacctcactcaaccttaacatggatgaatatttccaatggtgtgggagctctctgcttatcaaggtgatttcttctcctgtgagatgagtgaattaatgccagtctcctgtctctgcgcaaatgtcccttcctccttctttcttttactcactggacttcagtatgcctttttgaagcaagagtgtagggaaacaagaagagctctctgttcaacataatatccctttaaatattcagagacagctggtaaatttcattgttaagacataaaagggactgaaacatttgtgagaacaaagaacatcctatgcaatgtatatcacttgcattatttccttataagttgaaatttatgcaattcgaaatgctttactacacattttaatgtagtgcaggtttgaaatataacatactgatagttcttatattcttgataaggtggtaaactcagtacaacactatcatatattaaaaatactgttcacatttttaaatattgcctactttacccagatgtttccctgtcataccatctacatcctgtatccagagggtaaacagaaaaatcaaatcattttaaggggatattttaaggctttctcttttggttttttactcttctgcttacagatttgtgaattcctagggaaaaaagcattagttttaaataaaatgtgatgtatgaattgaagtaatagctataatttcataaaataaaaaaattctattctagacatagtggcatataaatggaaacttatttttaatttttgtattaaagaataaaataatatataaattatcactaatcatatgtgtacagctttttgatgccacgaatgtgaacagagaacagtataggccctggaagttttattttaaaaattaatattaaaaggaattttagtaaagaacacacagatttgcagctcaattgacagcaaactattgaaataaagccctcatttctgggtgtggataggtaactgcacaacgtctctgttgcttcacttttctgtttcactttgactggccaaagcaaacttactaaccacttgaaacaattaaataagagaatactgattaggcacaaatgaatggatttatgctaataaaacatatatattatatgaagagtgacatctgtgaaggatttcattatcttttccttaatattacatgccaattttcaaagatctgatcatcatgtagatttagaactgttttgcaagtggttaggaatggccctctgttgagttttcattacttgagaggagatatgaattatgtatttaatggcaagacagcaataaatgattaaaggaaagaaacctgtagcttggacttctcacaaaaatgaaatttatgtgaaaataatatgtaaactttactacaaaagttgttatacttccacaagcatgcatgaagataaaatacaaatttttgtcactatggaagcagggttattgccaagaagattgtagataaagcccaaacaatgctgatttaaatgaatttaaatagatttaaagaattgatcatgtattttaaactacgtttaatgttcttctttcagtattcatgtgctacatactatacgtttaggaagtgtgtataatatccctgggagaatccttggtgaccaccactgatgatttgctttcctgtcatcattgaaagaagatttgtgaaattgtgttacaaaaaaaccataaatcttctttatgtgtttcttccaatagtaggtcactttactgtggatttgttgttgtttttatatatcacactctgtttaaatctctatgatcatcaggatgcattccacccctgaagtgacagggcaaaccggtcttccacagggaatagagaaggtgagaaagcacagttaaagagaaatgataattggcctaaaatattcataaggagtggacttgggtggatttacatagtacataagcatccctaagtctgaaggtcttagaagtagaccaaatacatagtaactggaatacaacatgtgatctgattgtatgacaaatttgggtacatgaagttctaaattcttcattaagtcatgaatattaagctagccctaggatttaatttctgatcttgttgagtgctgtttcatgaggcaaggaaagaactgcaaactcaaaatttcttactcccgtgtttggaaacaactcagtaatacttgaccagtgtatttcaggtggtggttgctttatttttaaagctatgatatcctttgttcaaaggaaattctaggagccaggcaaaatagtcataagcagaactactttatttaaaggtggggggaaggtcttgaatggtgaaagcttcttccttttcctctgtatctgggcaggaaaggtgcttttggcataagcccagaatactttgatctgaataacacttagatggaccatgaacaggaagcagctgctgtttctaaaacatggttaaaattcatacatcttacctggagtaattaaattagctatctgatacactgccaattaattccacctctaagtgttgattatatattagtttcattctgtttgcagtttttatgaaaaatgttaaagtgactttgggagctcagccctcaggaactactgagtgggtaaattcaagaaagcacaagaaattttcccctgagctaagtgctcaagtaggaggggaggcccactttaaagagtaaagcaggaattagcagtatgtgtagcagaaacctggatatagaactaacatctggaagaagccaaagagttctagaattaaaaacaaaaatatttcaactggggagtccaagtcattcattcattctgtcagtcagtcaatcaatcatacattcaacaagtattttttaagagtatattgtctgtcagacacttgctggccatgtagcaaaactgaaagataaatcacattgtgggaagagcagatatgttttacataaaccaaataatactgggaagtaacactacttggataaatgactgtattaggtcattcttgtattgctataaagaaatacctgagactgggttatgtataaagaaaacagatttaattggctcacggttctgcaggctttacaggtagcatggtgctggcatctgcttggcttctggggaggttttaggaagcttacaatcatggtggaaggtaaagtgggagcctgcatgtcatatggccagaacaggggcaagaaaggggggtgagggagatgccactctcttttaaatgatcggatcacctgagaactcatatcatgaggacagcacaaagccatgagggatccgccccagtgatctgaacacctctcaccaggccccacttccagtactggaaattacaattcaacatgagatttgggtggggacaaatatccaaactgtatcagtgaccaaactcctttggataaaacagaaaaaagaaaaaagtgaggtaaggggcatctgaaatggatggactgagatagttatctctgttgtcatgggtcagttgactcatgcacaaagcacttaggtcagagtttaaaattaatttagatctatacaattctaaatttttatctagagacttttcaattttgctcttttgttttttaagtttttttttttttttttttaattttgaaacttcggccacctccaagtgacgaaggggattacagcaattgaaaggctcctgttaatcctcttagtttggttgtggggtgcagcctatgggccagtaccaaaagtgtgatcagctagaggctgaggggatgttctagatgtaagactgagaggaaagaaagcaatagagcactagattggacctggtctagtgtgaggtccagagtacctctttttcattgggtatctgtgtgtaagagaagcacagttggcccctgtccatagtgaaggtactgtttctactctatggaggattctctgttcctagtggtcaatgccagacatttcaatttagatgctgctaaatgaaaatatacattagaggtatctattcatcctactaagtatttattcttcaatgtgaataaaggatctggaaacaattctgttaatctaatacctcaggtgttggatctctgaaagaaaatgtgggaaaccactgaagagaataatgagagctgaagatgagtgttattgtaaggttctgctttgatggggtaggtttaggggcctctaaattgtagagaccacaaaaaggaagctcctaatagaaaaatgaggacttaaaggaaagggcactggatggaagagctctgtgctgttctttgtggaagaccctgtcaccaaagttcccagtgaaaagctctcagggggattatggctatgccttgaggctgggtggaattcagatagtaagttttcacaaacattttggggtccttactacatactgggtactgttacaggtaccggtgatagtgaagtcaacacaacagacatgctgtctgtgttagtggagactaaggaagataggcaacaaacagatttttatttcttaatgccttatataaaaatgtataagaatttaaaattcttgtgaagataagtaactgattctaaagaagaataaacagggtgaccctacctagtcctagaattgggtaagacttcccagagtaaatgatgcctaatctgagacatgaagaatgaggaggagctattttggcatagagctctgagtcaggacccaaggaatggttctttggaggttggctcagaggccgaggggcaacaagaaagcaaaggctgataggtgaggaacaaccatgcaggaccctgtaggccctgtaacaaggaaataagaaaatcatctcaagtagatagatatatggcctttaatccaactacagaactaaacgtgatcattccatagtcccaacagaagcttttctacttcttctcagtcatgccaaatgagataggtaaccatgacttttttgttgttgtttttattatttggaacaaaaatcagaaataatttataaacaagaaaataggagttccaaagttgagtcatcactaatttaattacatgtgcagtaaattcaggatccattcctgtgtatagctctataaagttaattttcagttcttctcttcttataagagtcaacagacgaggcaactctcctcattcctgaaaagcatgtatgaccactgaaatatgagccctttccagtgttgcttggtgacaaagcttgtctctttctatatttatttaaaatttgaaaataaaattgtgatgtgtgtagggctttgtggtatagtttatatatgtaagttgccttgattcatgcatttctgcatgttgtccctccaattttaaggtgggaacatggaaattttcccttctttgtactaagtacagagaggtgcttacaggtattgattttagagttggactgagctggtttgaccttctattccagctctgaccagctgtgtgactacttcaccattatcaggctcaggttgttcacttgtggtgttacttgtcttatagggcctttgcaggcagtgaatgagctaattaatgttgagggcttaacacagggtcttgcacaatagtaagtgtacaatgaaaggagctgatgattactttgatcacagttggcttattctgttaaaaacaggttttcatgactccttaaaatgttctcagtagtgacggggaacttaaaattgttgtatcaaattgttgaaattgttgctcttctggatggccctatcagatcacattatactgtagttggtttttattgggaagagaagttcaggcatgagggccagttagcatcatgttgagcacaactattgcaaatagcagccctgtgttttcacaactctcataataaaaaaatgttcagtgtgtgccctactttcctggtacagctttaattcaagataatgatacatttgtagtggcttttctatttctcgtggtgttttgtttttttttttttttttttttcagagcaaattgagttaagtagaccagttgttttcatgaacttgctgccaagtggaaggattttttctctcttttctataaggctagatatttaatctaaaactactgtctctgtgctgggaagcatccaacctcattactgtttaaatgtcttactgtctttggaaattctgatgaaccccaattagtaacccataaacccccccccccaccctgttcacttcgttatttaaaataaggaaatattagtgcaaaaacatttgtatcagtgtctagtcaggataacagaaattattctcagcttttcaaacagaggtaatccaataccaagtaattgtttaccgatgtgttaaaaagcctgagggagagaaaagagttagttgctattacccagaattagtaattgcaggaagtcactattgcccctagagctggaagggcaaaggggaaagtggtataagcagtattatgtggaccttacaagcatgtacctgggagtgctgcagctgctgctgaaaccacctgacctttgctttgcaggcatccatgagcccacagtcctgctggtgctactggactcactgacaaggtgagcgactggtgcctacaaccactggctgctgccataatgatgctggtattgcagagaggcaaccactggcctggtgctgattctgccaccgccaaaactcatgagcgctaagatgctaaggcagttggacacagaagcagaagaaaattaatcatggcttcttttcttctcctaacttccactctcccaccagtcctttcctttggaagacccaaccagagaccagctagcaaggggatctggaataggtactttactggcttcaagccagcagtttacaggcatgcagtcccagagtaaagttgaaagagtgagaatagagctgaatgctatcagacaaatacccagcactgtatttagaccatttaatataagattgcagaaactggccgggtgcagtggctcacgcctgtaataccagcactttgggaggctaaggtgggtggatcacttaaggtcaggaattcgagatcagcctggcctggccaacatggtgaaaccccatctctactaaaaatataaaaattagccaggtgtggtggcatgtgtctgtaatcccagctactctggaggctgagggacgagaataatttgagacccagaggcagaggttgcagtgagccgagatcacaccactgcactccagcatgggtgacagagtgagactccatctaaaaaaaaaaaaaaaaaaaaattgcagaaactgagaggaagtggcattaactaatgaaggaaattattttctgaatatatatgtatatatctgttatacagaaatctaaagaatgggtacaaatatttatattcaactcacacctcatgtattagtttcccactgctactgtaatgaactaccacacatttagtgaaaaaaataacataagtttattattttgccattctgtgggtcagtgtcactaggctataatcaagttataggtaaagctgccctgctttctacaggtattctctcaaaagagaattcattttaatgttttttttccagcttctagatagaagttccctacattcttaggctcattgcaacctatctccattttcaagctagaaacttcctctcatgctgccatctttatgattctctgtattgggaaaaactctttgctttaaataactcatggttcgatcgggcccacttggataagccaggatactcttcccatgtcaaggtctttagttttaatcccatctataaagtctcttttgacatgcaagacagcactcacaggtcctgatcgtggacatctatgaagatcattattctgcttactatatctcagaattttagactcctatacatctgtagttattcactggctattgttttccttagaaatctcaaacatgtaatctttaaaacaaaattactcttccaacaaatattcttcccccttggttggggacattgtcttcatctagcagcctaggcttgaagcttgagaatatttttctgtagtccctcattagattgggaaatctgctaattttcattcctaaatatatctccaatctacccctaccctgcacttctcttaccactcctatatcctgccaaggaaggcaggcattaccctgaaagtacttcttgattaatggtgcctagcattgtactagctggtggagccgccgatatgcataaggtatccatgttgtctgctccaatggaatgtgcagtctagcatggaaagtgcacattaaacaaataaatctgtggtaaatgtccatttctgatctttctgctcatggctccccagttccattttcaaaaattggggttttaaaatttctgaatattctaaagagaggacaatttgtgttatttaaaagtaatcaaagtaagtactttttgtgcatgtgtgtcacttttccctgattctgagatataaagatggcaaaaaagactactaaatgacatgtcaagtatggcaatttaattttaataaaatccagctagaatggctttagggctcatctccatcaattgttgtttaaatgagattaagttgaagattttaggcccccacactagacttaatgaatcagaatgtctggagtagggcctgggctatgcattttaaacaagtattccatgaattttttgtgcccattgacattatgaaattattgaaccaatgtcaactcatgaataatccctggatttataacactgaggccagaggatgaggaaggtttcatggctggctcactgtctgttctctcctttttccgctagtaactcctgtgaatattctctgtgaagcttccatggtgactaaatatctccctagtgcccagttcacaatcagagtaacatgcaggaagcactcactatatgccagacatacggtgctaaagtcagcctttcacgtgttgtcatatttaatccttaacacaaccttaagctggagacactgttatctttcatttgcagattaaagatcgaactttaacttcacattttactacattgcatggaagagtgctggggcttcattccagggctttcaaattacaaagctcaaatgtgaaactacttctctgagaattgactattattccctctctgtgccaccatgaaaattttcatattcttttattacagaataatggcatttaaattgttgattcacatatctgttctcctttcttcgattcccccagcaataggatcagtgtcttctttatccaagtaaatgatagccctaaggtgctacagggtctatgcgttagaagatactcaaaaaactgtccaactggtcattcattcattcaatctcagctgatttagagtgggtcaaaatgtaaatattaagtaaaagtaaaatttgggtatatacataatcaacaaaattaaaagataaaacttatatgaaaaggtgtgcaacatcactgatcatcagagaaatgcaaatcaaaactacaataagatgtcatctcactccagttaaaatggcttatatccaaaagacagggaatacaaaatactggtgaggatgtggagaaaagggaacccttgtacactgctggtgggaatgtaaattagtacattcactaaaaagaaaagtttggaggttcctcaaaaaactaaaaattagagacatactcatatcttcagcagttaatttgtatgtataatgaactgatattcagactttttttaagtaagaaattaatggtaaatacttttttgtcttttttttttttttttttttgagagaggatctcactctgtcactcaggagggagtgcagtggcatgagcatggctcattgcagccttgacctcccaggactcaggtgatcctcccacctgagcctcctgagtagctgggactacaggtgcaccactatgcctggctaatttttgattttttgtagagaaagggttccaccatattgcccacactggtctcaaacacctgggctcaagcgatccgcccacttcagcctcccaaaatgctaggattacaggcataagccactgcatgtggcctaatggtaaagactctaattgacaattacaaaaaactataaagacgctttctgagaacccaaagacatcaaaagtgtgtaaattcaaaagtgaagcaaatacttttcaacaattttatctcacgtaaactgcaaataatgatataatttgaaatctcttatctttcttcacaggaagaaataaaaatgtgtattttgcttcccttatcattatgcacttttacttattttataatgtactaattctgttcatgggtatgaatattaaaatctaatttatacatcaggcaacaaggcacagtagtattattatctcattcttttaggcacatgtagttaagcaacacatttcttgttagaaacacataatggaaacaaaaccccataaaagcgacacaagtctattttaatcttagaatttgagttctttaaaaaacaataaaaattccttcgtatgtatattaagccatttaattgaaagagtggagtaattttctgatattcacattattattgaagaatataagaagggtttccataatgcatactaatagaagttaattaaatgatcagggtctggttatctgaattggcattcaagcgtttattgaagtgtagctcatgttcttcctgaggatattaagagcagcagcagaagcctgcttaaggacttaccctgggctttgacttgctaaaacatgttctagagtatcttcagcctactgactccttgttgtagagacattatatatcagcagcttgactaattggtctaacattcttgaggtcacccagggctactggtcagaattcaaaactttttatgtccttgtcacaaagttgatcatcataactgcattatggaaagtgtgggccagcagactatatgccaaacacagcttaattcaataaacatttatggagttgctgataattttcttatatcatttattttatttaatatttctgtactcattcaatttacaaaatgctgagacccagaggctaaacaaactactcaaagtcacagttagtgagtgaaaaatctgagatttgaacacagatcctcaaatatgaaacctgggattctttctgccatgtgtgagtaggttcctttgaaaatatcctcaggttactcaggctcttattagcttcaagagacaaaaacccccgcgacactttacctgacttaagcataaaagaattaattgattgagaggactcaggggtagaaaatgtctccaggccttggccaagatgggaaaggaaattgggagctgaggtgactcattgtttatagtctatttccaaatatctcatctctgcttcttactttagtttcataatttgctgccttataaaagggctttctacaccaatttgtaagtagtgactatcccagcttttgtgtgagtgcgtgtgtgtgtgtgtgtgtgtgtgtgtgtgtgtgttgtgtaatagggcaagagaggagagaaaaagagattgggttggggaggagagggtgacagggtcacacatctgtatctcactcagggaactatggaaagatacactctgagaaaagtccatgggcagctctatcagaaggagatcagaggagggacagggaggacataattaatagaaataatctgcattatttatgcaaagcctttctcgtacagcactgttaaacactgatagttaaccccctggttcttccacttgattaggagccattttatgaatcttaattggtttctttatttcaatttagttatatatatacatatatgtatatacgtgcacatgtatttatatacactaatatctccacctctatataattatatttcaaatatgcaaatgtatgtaattttatttacacaggcattttatttccattaattaactaggagtctccttcatcaaagagatattttgatgcttcttgtagaaacacacagtgggaaaacattgccttattgtcatttataaagtaattacttatgtttatgcaaccatcacttggttaatattagcagggagaacaaggtagtgtgagaaataagaaatggtgcttctgtgagtagaacttgcttagctatggttttccagctcctctgatatggtacagtattctgtgtaaatatctttagcagcaagcatgggtgagtggtcttcctaagaatcatcgcacaaataagcatttgtgtacaagaggactcttgggggaagcatcatacttatttcaacttaatattatgtgagatcactaaacatttcttcagttacagaatcactggcacttctgcaaaaaggccaaacgtgcaaatgtcaaactgataattaccttccctttatgtggtaaaaggaatatagaaactgtggaaatcatctcattaaaaggtaatattgagtaccttcataaaaatcatcctggttaaaaataattcaaaactttgtctcttacagtttattattcagctccctcaccccataagtcaacccactaagcacgtggctaaagtgccagacttataaatacttgaagtttttgcatgtcgtttgtgctttgtgagattgtagaaagtaacagtaatgtgtggattttgggaaaaattctatacccaaaataaggcagtagaagtgtagtcctgatttcaaggggagaatgagaaagatggggactacctctagcttccacactcctattgattagtgctgtgactttgggcgcatctctacatgcttcattttcctcactgagacactgggctggaatagacagtattagaagttcccttagtgtgatgtcttcatccataatatcttagaggtatgatagtcatatttcttaaaaaatagtacattttgaaaagagatgctgatcattgtcgaaggtgagtgatgggtaaataggtttgttatactactgtcttcacttttgtgaataaaaatgttcagagaaacagggaaagagaaacatagctgcagagaatcgttacaataatatgggaatggtaaaagagtagattgaacttccttgcatcttccatcctaaaaaacatgatacgttagtttattctaagaagttactgcaacataaaatgtgatataaacggtagaacatagtaggaaatgggaacagagaagttggaaaaatttccaaggccccttgggtcattttggttgaaatgctttatcattttgttatgaatgtcatataagacatattcatagtcaagtttaatgaatatacatttaatgaatatacattacaagtttcatgaatataattaatgaatatacattacagagataaatggttcatgaattcaccatcattttggatcatgcattattgctctttaaagtcattagtttggaaaagtgagatttgattataatttgtgacttgctagcatgccctaactgggcaaaaaaagaagtgacctggataagggccaaatttcagagcaaaatttataaatacaatgtggctgatccataaagtatatagaacacaggagacaatctgcaattaactgtaaaagtttgaccatggaaatagcagtgtattaacccaaggcttgagctgtaacattagagcttgcacatattctaaactcactttctgcacagcttagtttcttctagagattagtgcaattatttatctaaacaaatgtttattaagaagacaacatgctgttcctgagctgtgtacatagtcactcggggacctttaaagtccaggattattatacactgccattcaaaactggatagagcccttttaccctggggccacaattggacattgaatctcacatgaaaggacagaaccaacctcactggaaaccagaataaagaggtgatcttccttttaccaaaaactttagaatcctaaaagtgacctttatatttttaaatatactccgcacattcactgccaacggccaagcttttggaaatactgtctatacttgtttcctcaccagactctcgctcctcaacccaccaaatcctgcttctgcctctgccactttgcataggtcaccctctccaagtcaccagtgaccttcttgttattaaacttacttttacatttctttgttacttgactttgaggcagaaattgatgttgttgagtattctcctctttagggaatgttcttttctttctctgcttttctttttctgcttcttggcaatttaaattatgttatcttagatttctttgtagatggctctttttattttccgtaggcatttctcaagatttagaatgaggctttcttctctgcttattctatatatttgtgtgggtaatagatagcaccattcctgaagtctcagtcattatccagaaattgatttacaaatcttcatgttcttgacagatctacctatgagctttgaggaaatacatcaaactctgtattggacagtataacgttgatgattctcagacacctcaaattcggcatgttcaaaacgacaaacctcatctcactccctgtgaaacccaaactgttgctcctccaatattcttgatcttagggaatggcatcttcacctgcctggtacttcatcctagactctttcctcttcttaacattctattttcagacaaataccaaggtattggacacgtctcttgattctttccacctctttctattcagtaaaggacactataggagtctgtttttgtacagacttctattatctctttcctagattgttgtaatagcctcttctcttaaggtgtatctatacagtctcgttacctagttctcatccgatctgtttcccacaattcagagtggtccttctataatgcataactaaccatagtatttctctcataaaaataaaactgctttccatttctattaagataaggtcatgatacttctttattccgctttaaatgtttgcataatctggccccataccttgctatccagcctcatctcttatgactcccctttgtacttgaggccctgccttgtagaaattctttcagttctcccaacacagtatgcttcttcttgccttcagattttagaatatccctctgctagaatacatacatatatagataagtacataaaatctcctctgccaggaacattcccctcctactccttgacttttaattggcttacttctatttaactttcagaaatccctgtgtctttgttctcttagaggcattcctgatcctctaaattaggtgaagttaggaaaccattgtaacttgtatatccaggatgacaacacttattataattgtttaatttccttttatatgtctggggtgaagggagaaagatcctgcatgctctctaaggtagaaattatgcttattttgcttatgattgtacccctgctgatgcttggcaaagtgcctgacactgtttttcagctcatccttgctgaataactaaatgcagagagaaaataaaatgtaatatttgtcatatactcccagtaccatttgagagaaatagtgggcaagctatttcaatatagtaccaaaggacaccttggcacctaaattttaattgcaaatagagtagatgctataccagtgaatttggggagagctatagagagccctttatgtgtttgtgtcttccatagtccctaggatatgactctgcatataatgggcaatcaataaataattcttggattaatgtttgaatgacttttatttgactaaaggaagaaattaagctcaataagcactgctgattttttttctctttactgaatgcagatataagattaaggggagatgtaggagatttcaggctaagaataatctttgggctaattcctcttttagcttaatttattttaatttatcaaactgcttttattctgtttttctttcctaggagttcctcacttatatcagaaaatactgttagtgcctagctatttcaacaaagaataaaatttaatataatttatatgacctacacctcatctaaagatagcaatactggagatatccaaccaggaaggagcaatttttgcttgataattccaacaaaaattgtttgatttccatttcaataatgaaaatattgataatggcctgtttatgagattgcataacacttttgataaaagtaaaattaaccttatggaataattcttacagatattttaaatgattcctttttgtgataagacactaaatatacaaatgaaaaaaggccatggcaattgtttacaagttgctggcaggaagatgagtgtgcacacaaacatggcagcagaatttctagaatgtggttgagtaccatgtacagtgaggacagaaaaaagttccttgagtttgccagtcttcacagaggacataatttgattgctaagcagaattttgctaagagaagtgaggaagggtgatagaagcaaagagcatggaaaaattagggaactgttagagaacaaagtgtgagaaaagactatgagaaaggagaaagagacaagagaaaaccataaggtgaatctgggtagcaaagtaagcatggatcagagaatcaaggctttgcagattatttattatagaattttgctttttatcctgaaggtgaaatggaatccattgaataattttgatcaggggaataatatttattgagtgctgactatactcaaattactgtgaatttacctgttaaccaaatagtgaactctgtgagtaagtgtttatgcacacttctttaaagatgttccttctcattgagtttaaaggccttattactaggagtttacatatatatatgtgacagatgaatctgagaatattacttaaaagatgaggtttgcacagttttgttgcagtgaatttaactgtttcaaactgtgaattctgtaatgaagtgtttaaacgttcttcaaagatgtcaccatatgatgggaactttacaccattgttttatgggttaacaccaataactaatcgtaaaatacagatcctgttatcactctcattgtgcagatgaggaaactgaggtacagaaaggtaaagaaacaaattacacttctaaaaagttgtagaacccggtttcagttcagcaatttgacaccagagtggctctcttgattaaaccttctgctatactgtctttatgtttgatagaaacatgacataactgagaagagagagtaggaagaagaaattggagtgaggaaaatgcctaagcagggcacagaaacaagatcagacaatgggaacactgtggaaaacagatgaggattggattgattggctgtcaatcataaaaagaaagaaaggaatctaggataatttttgaatttctgacttagcagccgtttggagagtggttcattttatagcaacaaagagggtatagggaggggtaggttgaaggaatgtggcggcagggaatgatgcattcatctagtgcatgtggaggtgcagatgcctgtggggttccagtgggacttcttgagaaggccctgcatgaggactggaggccaggtggaatttggtgtagtagtgaagaaaacatgtagaattaaatccagaacccctaatcatggcaacaaggccctacatagtgtaaccctggccactgtcaccaacctcactcccctcttgcttccagtactctggtctctctggtattccttctgtccttcaacacaccaagcttgctcctcccccagagcctttacacttgttgttctgtcatatagaatgttctgaccgttaccaccccacctcttttcattcagatctcagtttgagaaggcttcactgaccaccgaatgtaaaccagacccattagttactgtcaacattatgacttttttcatagcacatgaaaccatctgaagtcattttctctatttgtttatttgttttttgtttcctcttccagagtatatgctcactggaaacactggccttgtcttttttaccattgtatcttcagggtgtaggcaggaatgcaaacaacatagttgtataacacatatttgttaaatgaattaatgaagatacaaacatgtatttgaagtcattatctcttagatgggagttgaggtcatggcattaattagaatgaattagagaagtgtgcaactagagtgatcagggaaagagaagaatgccttgacaacactattattctcttcatatcctctttaaggataaatggtaatcttttcaactgaaattacaggtgaactaattctataaatattcacattcagttaaaaatggtttctttttcatttgaaatttatatctacttatgcttaaataaaatatatttggtctaaattgtatggaaaatctcttttacatttctgcctatatagaaacatactagcaaaagtattttaataaatccaaagtccaaccattgttagaaattaacaactaaacaaataaccaaaataaaatgtatcaaagttggtctttcaaaaatataagaaaacacagaaatggtaataagaactagtttttttgtatagcaactcaacatgaggccagctaatataaaatttttctcagatattataaactgtccataccaataaaaagttctaaactaatgagaaaaagtgagtagacaggcataatttgcttaaagttacttacttgtagaggaataaaggtctgcataattaatgtggtgaagttaataatcacaagaccctaaatgggagaatactgttatcttgcttttattgttactgttgttacactgttataccagtatactgttacatttccttttaccattggcaaaacaccttaatgtctttaggtctcagaatctttatctgtggaataagaggagtcaaacagatatttgaaaggtactttttgggttctctctgtatgctcttaaaatctatgcactgtttttactacatacatcctgtccacaggtaatcaggaaatttaagtaactgaccacaagggggagaactttaattctgcattaaattatttaatacaatatgaaatgatttgaaagtacttggctatgtgaggttggtgataggctgcttcatttccacttccttgtggaagttggggcattctactgctaacgataggtttaacttaattgaaatgtggttttgtgtttgtagagttatgatacagtcactggatgtcaaattctatttgtattaagcaataatgctccatgaagggatccagatgccttttttattaaatttatgatagtagaatgttagaattcaccctggaagagtttttcctttcaagtaatattatttaagttattctgcaagaaatctattaccttcttgaatgtcaactctgaaacaagcataggattatcaacggggcagtctgtactcaagtattcatataaaaagaaaagaattagaatggtgctggccacatcatttgaatgttatgtgatcattggctttatatatatgttcgctgttatatgaatattaaatattatatgttcacactgttaaatattcatttttctgtgggttaagttatgtactcttatttaaaattttattttaaggcaactatagctttctttatttttaaaatattttatttgaagttccaggtacaagtgcaggacgtgcagattttttacgtaggtaaatgtatgccatggtggtttgctgcacctgtcttcccatcccttaggtatcaagccccacgtgcattagctatttaccctgatgctctccctccccttgcacccctgacaggccctagtgggtgttgtttccctccttgtgtctatgtgttctcaatgttcagctcccatttataagtgagaacatgaggtatttggttttctgttcctgcattagtctgctaaggataatgccctcccttctccatccatgtccctgcaaaggacatgatcttgttcctttttctgtatagtatatattcatagtattccatatcacatatcacatatacatatatcacattttctttatccagtctatcactgatgggcatttgagttgattccatgtctttgctattgtgaatagggctgcaatgaacatacgcgtgcatgtatctgcattctattataactttcattgagttaagaattaccttatcagtcatactaaggcttaaaagtttacattttggatttcattaagctaaatttgtaaggtataaatgtaagatttctggattttatcaaatgtacccaaacatacacagctaaatgagtccaatttaaagacattatatcagtgacctatataagtatctcaataactcatttgttactgaagacaatttgtacttccccttagaagcattgtcacgctctttttaatatgttcagtgacagcagatctgtctttgagagtgagtataaattaaaaaaattctatcaatggagatcaaatcttaaagttactaattaagttggagtataacaataatttggagatcaaaaattagatataattaaaatatttaagctccctttgatttataaacctcctttattcaactgccaaagggtcccaaaatgttttcagcaatggtgttgctacctggacaaatataaatcttcctgaagtgactcctatacggggtaaatttatttgaatacattcattctgatgtgttcacaaaaatgaacaaataactatataaatgaaattgtttatagtcacactgtgtttattttccagttattttcatagtgagccttcatgaattctttaaaattacgatatgctaagtaaatcagcaattttatcgttgagagatattctataacttcttccaaaaatgattaagattgttaataattctctttttggcttagtgaattaggtttctattggtattctcacaccaaaaagtattatagacccataaaaaatctatgccaggcagtgtgttgaatataccccctattgctacttgtacacccagtgactagcacagtgattggcctactagtacatttttaccagtagctatccaataaattttggtacataaattaatgaataataagtgatacaaagagcttatacacgtatatattatttttcccattacatatgtattatttttccacagtgctgcgtaatcattcacccaaaccttagtggttaaataaacaataatcactaatgttcacagaactctgatttgggcaggactcagtggaaacagctcatttcttctccacacaatgtcaactgagctggcttcccaggtttactggaagcctggggtctggggtcacctgaagtctcactcactcacatgtctagtggatgataggggctgttggctgcgaccttagctggggatgttgtctgaaattgctggattgctcacagcatagtgtttgaattccaggagctagcattcaagtgagcaaggcaaagtgcacatttttatgacctagccttcgagatcacacggaataacttcttttgtattttatcggttaaggcagtcacagaagaggtctgcctgcattcaaggggagagagttagaagccactacacaatgggaggaatatcaagctcatgttgtaagaaaggcatgtgggattggatatattgcagtaaccatttctggaaaatacaatatgccatattttctgatttataaatatataatttttatccaaaattcaaacttctattcactagataactttagaaaataatattcccaaacaaaattcaccctgctaaaggaattctatctgatccaataaacatttattatccattattctcttacatatgctcgtcttctctcccaaaccactttcacattcatgctaatcctggaccaaggattgtatctttgttgaacgttttctctattccttttttgctgggaaaatatttacttacgtttccagtcagtttatcactaatcatttactattgacatgcccctgtgtctttttcacagttcaaagaatagacagcataatgctgtttaatattaggtgtttttttctaaattgatataaattttgaaagttatatactctttcttagctagaagaattctcattttatcttaaacatttttttctgttactaacttgaaagaaacttcagttaaaactgaaaaataccattctaattaatgaagtattacaaaatttggaaaatagaatggtcttccctaaaatttgattctgttatgtaacaatgatgcatatcatttttgtttattatatacattttgtttgttacatacaatttggtcagtattttcatatgcagaacaaaattttcttcaaatgaaaaattgaggtgcacactgagattggtttgtcctcaaagaagctaaaaatgaaaaaaaaataataaaaaataaaactataatgataagtattttctccattaactccaaagttggtttcgtaagatgttaaggtgatttgggacaaatatcattgcagttttcaaaatattgatgtcaattaattgtttaaacaagctaaaaacttttaaacaatgcaaaaaatattcatctggataaaagaagggatcaacttgaaattggtcacatagaaattatatataattagttgctttctagaaagtgaattgagaaaataaccagattgtttattttacataaaatcatttagaagtaagtgttaatagtgggcagataatgttttctgtgtaccctgccatattcctcagtgcctggcaaatgtttgtaacatagagggatgttcaataaatgatgttgcatggagtagcacaatgccacctgataatgtattttcatttcattccgaatagctattgttttctgtagctttataatggtctcaatattcttgattatataggccagaatatgtgggctttggaaatattttcaataattagattttgttttctgaatgcaggaattatacagtgattattcctttacttgtgctctcaaagcccttcctatatactgctactataatgatatattatattacattatatgtcatatcgtaactacttctacatgtacttgcctctaacctgaggttgcaagcaactcaagggtgggatttttcttctcgattttgtaccctcagaacactatacttctgctatgtagtagtgactgtttattaactcttgagggattggatgataatctgaattccgtttgtcttttttcagccatacttttttttgaaaagtgtcaattcatgaaaatgatgttaatatttgagagcttatgataaacttattaaacccatctacctagtaaaataatgtattgaacttaataccacaacaaatagatacattttaaagtttagctcaacatactctataaagattaatatattacctctgtgtatattgcaatgttctgtttcttttaaaagacaccagtaactttaaaaatgttttttttatttaagtagcacaaactccttaagagacatgggcacattatccctctcaatcctagaaacgtgaaggagcaggccataccacctcagaatccagagtgatgtgtatgggtctattatacatgtttataaatgttgccgggtccatgaattcttcggatttgcacaagtactttatgatttgttctgggaggagtaggtcaggtgcaacttggtgtaagttatcgcctggtcctttagtgcctactttcatagtctggcaaaggtagagtgacagtttatgagtttgtgtgagaaaatctgtgatgacctcctttagggactgtgactgtgtcacatcgtcgagatacataactggaacttttatcactgaaacatgccattgcataaaaagcctcattggaatgttatgagaaatgactataattttcatttgttgaataaaaaatactgtttcatctttgacatggccaatataatctaaaagaactttgtagagagtgtcgctggaggactcgaggatatgcagaatggaagtgggatagatgagcagcaatcctgtcactgcttctcctaggtgatgtttcaaaactgactgaaacatttgttcatagtagtcagcaacatcttttctttctacatttgcttgtatcttggccactagaaacatcctatcaagaaggaatttctttaggtgtagtcgttgtttctcttcttgaaagtgcaggtaattgctacgtgggacttggagaaaaagaagaggttccagtggcaaaggccttttgctgcccttctggttatggaccgaaaaggacatgaggagtcttatttatttttccagatgattccagcttttagcttatcataatatttatgctgccagggtacctctttactgatgaactcgtgtttttatttcttctgacaaaaaaaaaaagagtaaatcacggtttgtcaaatgttactaaatagtaaaatcccaatcttttgccagttttatcaggaaacaatgtatttgaaatgaaagacaatgttaaaacaatactcaaactatagacttttttaaaagtttacaacgaaagagttaaataatatcctaggaaaaaactttgtaaatgtcatgtaatggtgattacagattgtcctttataagccaaattttttaaaaatggtattttatggtaattcttccagtttcttttacaaatctaactgatctataacttttaaaaaaaaatccaaggctttttaagtcctaattagcttatgtaacctttagtcatgtcactaatagttaataatgttccttgaataataacagtaaacatttcaagggaaaagttttggttctttgttttttctcctatcgacgaatctcagaaatgattcatttctcccccctttatttgttttcttgttgtttttgttgttgtaagggctacatgaaagtattctgctactttaacttactctgcttacaaatctcctcaatttttttttccaggtcaacttaccatttttcttttttttcctgtgcttctgtcacgcacctgtcctcgaggccctacttgtcctccatcaggctcccaactgccagtcctctggtgttctcagctgtcctgtgttctgccttccctcgggcatacgtgagtcagaatgtcagcaccattaaaggaccagagcgccaagtttcttaatacgggtatctcgacaaacacttcaaagtcactgcagaggaagtgtgaatggcttattcctgaatggtttatttttagtcaggtgcatttgtaagtcagacagatggtgagaatctggacatctttttcctttctttttttccgtttgataaataaaaagtatggttgtagaactcctctgttctacttagacactaactaaagacttcaggaacacatatctgaatctatctaatggtgaatatatgatgagaaagttctatagtaagatttggcttacttaacttaatgtgattttaagagatgcacctcttaaaattgtgtcttaagagatgcatctcttaaaattgcatccacatgagttctaaacagtaattttaaaacaagtttaaaaaacgtttattcaatttttaacaatgaaacctaagaataattttttccctgagttctgtattatccaaactaatgatctaattttaatgataatacaatgataaattatccaagtaaatgaaggcagagaggtgacttaataattaattaattgtgtaatacataaaaatggactattcttcctcattgtgattcactttatcactccctgaagcaatacaatctttccgaagatgtaaaccatggtgccaaaccatgtcattgcccagtctagttattatctcactctcattcttcttacagctttgttggaagaaagtgtccatgttgaccagagccttcattatggccttctctcctctcctggtttctatgatactgcactttcttggatttctttctaaatctctgtatgaggccttgcccggcaataccttctcacatccaactctggaaaatacttaggctctgcgctcatgatgtggttggatctctcgctctacttctttgcccagttagctcagcaccatctatatgtctcttttgtgagggcaggtaagtggtccttaaagccactcttgccactagattgcacgtttgaaattggaaattgatcatggggctttccttctgagcttacctgtggactaaaaatatttttcaatctgagtctcaaggtagacacaactagttaattggggttgagaaagaagaaaaaactgagctcccattctagattatttttgcacagaaaattctcaaattattatctccagtcacttattcacaactcttctctccttggatgtaactctgtcttttcaaatttaaaatgaaaacatttaaacaattattttccttattaaacatgtttccctttacaaataccccacttgtgtctaaattaacatgttttttcctctcagttcccaggccaaaatccttggtattatttgttcatgtttcatccaagttatatactccaactctattctttttactaagtctttttactcactttaatatgccttaagggttcttgatttacactacctctttcatagtcctacttctttatttggattataataagggtctctacccacagtatttctagatttctccaccccacaaattcagctaagagtgtgaaaccataagccctttgatacatctactttataaagttaaaaagattctcattttacaaagtcctccctgctttctttccctccatagaatgctgggaggcaaagcctctgccttcaccacatccagagtgacttctggtatttatttccaatttccagtcatggattaaaccagagagaacatggggacaggcaatggtgtgatttgttacctaacacagctactgatcaaagtcagtaggagaatttatgaggtactgctacccaggagccccttttcagtgcacaaactcaaactagtcttttatacacaggtgagattcttcctcttcatgaaactgttccttactgacagcccaatttcttccctaacatggctgagaactatccctcaagataaggctaaccccaggatgtactgttccacctcaactttctgttgacttcatttacatatttttattataattatgttctcaaaatataaagaattgccacagcaaatgagagtgatgtactatcaagttttgaacaagattgttaactcaccttgtcagtttcccactatcttcttggattccctgaatctcagaataaataataaaaactatttcatagttctgcttgttttatcttctggctttgctcattctcctccaggtctagtttttgtgcactgctttttccaaatctcttttttaagagttctatttccatgggtatcagaaccttgatggcttcccccttcttctaaatcatagctccccactctgatcaatacttccaacacaatatctctctgataatcacatgtgtctttctaccttttactcctatcaaaagaagcttagtggtcatcttttctcaccatgtgtgctttttgttttccttttatttcatatatctagattcctccaatataaacctaatagaagaatgatatttcatcatgataaacatataaactctatagaaaatcaactaagctctcctttcttcaaaagagtgataatatcttaacaaagcctaattgttgttatcttgaaaaacatatgaactatcatttctgtaagtcaaaaaaggcaagtagagacaatgttgcatggttcaaactaatacattcagaagcaatagtttttaatctccatggatggtttgacatctttattccattttcccaatgtaattttccattttcaaattatttttttgctattgggttgcttcctaaaaattttagcttcattgtcacatggctatctgaaaggtttaaaggcaacttgttttcttatcattcatcaatcacactctgaactgtcaagagtaagttctgactagatagaaatagaagcaacatgcaattcagacagtttttgattcattgtcttgtgtaattagaattgtacactctctgctcaatggacattcagctttaagtgcccaggtgccacaatccttatgtgccatctattaagggcaagttatttaccttcagatggtgactcaagagaactcttctatctgtctgtctacgtatctggataaagaagcatttgtgttattctacccagagtgatctgtttagaatagctatccaagttcaagttcaaacaactgataagtcacagaaccttaatagaagcttaggatgccaagtcttctttcaattattctacttatctacctttttaattcaacttatctgatgttaatacatagcatatacttgtaactcgtgtcaaagagtacaccttactattactgatatacttatgccctggtttcctttttcagaaccaaatgctcctgaataacaaatttatcatgtcctttttgtttttgtaagccagacagaaaggattaaaacaattaaataccatttattatttaccatgtgccatgcactagatacttttacatacagtaactaagctacttttaacagtaaccctatatgatagatagaatcttttctacagtttatatgggaggaaaccaaaatttagagtagttaagtattttgcacacaattaaaatcttctctcagcagcctccatattctgtctacctgggtaaagaggaggtaaattatctcctatttctatccatgaccatagtgtcattcttccccctgtctatgagatgattcctctggaaccaaaggataccttatggtttggataaagtaaatttaaagaaaaacttctacattatacctaggtttcagcaacatttatctactgttattatctactcatttgtctcagatttattgacgcctttggtgtgccaggtgatatcattaggcactataagaaatgtaagtctggagcttagagtccagatttcaggagcttagagtcaggtacaggtgatgaaatgtacatgaatctgagatgttcttgagacagagcagggaaaaacaataaatatcatgcaaatgatgtttagtgctttagaaacaccaatttagaaagggtaactctggagttttcttagaaacgttagtgaaagagttctcatttgagcgtggccttcagagaaacaggattgaaggacagcctcatgaattggtctcacatacattcctttaaaatgtgaggttgtgcacttactaaacttgatttccatctggaataccaggctttaaactctcacctgtgctcaggtcctagcgaaacaaaacactctaaatcatttcctttcactttatgtcttatatcaaaatgatcagccaaagagaactaatcatctaaataaatggcttacaacttgggtacagcctttcactaagagcacatataataagctattgagtagacaaaaaatatatttgatttagcatagcaaatctgagtgagcttagttatcaaatcactaggtatttgaacatttattgaaaaagacattccccctccaagaaaaaaaaacaaactacattactttctctggcattgactctcttcaccaatagtattacggaacagtgtttggtaattacttatcaaggagagcgcaggctaggaacatttagttaattgattacaacatttcacatagttttcatctatttactatttgtagaaaaatgtgccaggctctatggaaatattcttgtgaatcagatattttatctgcacatgaaaaatttaattctgttagtagatcttaagatccccatgactatgtttagtacagggctggatgggcgtatacaagagtgctaagatataaacaatgaacaatgaaagcacaaaatttggaaacatttaaatttggctggaagaatgagcatttaagctgggaattaaaaaatagatatgatttgtgtgtgtgtgtgtgtgtgtgtgtgtgtgtgtgtgtgtgtgcttaaagcataaacagcagagggcatatgttaaagataggaagtgtggcacaccattaagaaaatggaaacaatctgttctggctaaagcactagtcctcaaaccacagaatctgcaaatttgttaaactgaagattcctggtctctaggccaaaaatgtctaagttagtaggcttaaagtgagacccaagaatttgcatttttgacaagtaatctcccagtctctctacatacctcactttaagaaagaagaggctaactcacagtgattcaaaccctgactgtctattagaataatctagtggagaattttttattttattttattttatttccataggtttttggggaacaggtggtatttggttacatgagtaagttctttagtggtgatttgcaagattctagtgcgcccacccagcaccccaaaagccagttcccagtcttacttaattaggaattccaccaggaatggaaccctggtgtgtagtttgttaaaacctctccaggtgattttaaatgtagcctggagcagaactgctagaaggtgagtggtgggaggagaggggaaaaaaaaaaaaagtaacttggaagcagtttgtggaggacttctatgccacgctcagaagtttgaattttactccgtggataatagagaatcatgagaatttcctgagtgcctgtaattataactgtttaggaagttgccctgaagtgcagaggaattggagatgggaaatactagaggcacccagagcccttttaagaactctgcagttggcaagtgatccctcttatcttctgccagcttaacagtaaattgtttcaactttgctgaaaaccaatttgcaaatgtaaatcataagcttaaaaatctactctttgactaagtaatgcctcttctagatcccatggtaagtaaataaaattatgagtttcacgttgaagctaagtgaagaaaaaattttaaaaaagaaacaaaattactgacaaacatttgaaatataaagacagtttttatagaaaaaaagaactttgaaaaaatgaatatatgtattaatgaacaactactatgatgcccttgaaattaattttgaagaatatttcaagggaggaaaaatagttattcactgaaacgaatagcataatatgaaaaattatagatatttaaaaataaaatttggatctgatatggtttggctgtgtggccccacccaaatctcatttcgaattgtaatctccatgtgttgagggagggatctggtgggaggtgattggatcttggggcagtttccctcatgctgctctggtgatagcgagggaattctcaggaaatctgatggctttaaaaatggcggtatctcctgtgctcgctccctcccgcctcaagtgaagaagctccttgttctgcttcaccttctgccatgactgcaagtttcctgagacctcctcaatcatgcgaaactgtgagtcaattaaacatcttttgtttataaattgcccagtctcaggtagtatctttataacagtgcgaaagtgaactagtaatatctttcttcaggcacaacttttttctgttttgtttttaaatcagtaaaagaaactgggtcctagaagctacagtggtctaagcagcagcaagtttatgcattcatttttgtttttgttaaaatacgttaaaattgtcacactgctggcacacctcatttgcatgaaattctgtaccacacttactaattgtagtaaagtttccccctatctcagggaaaagaaaaaaaactactctggaatgtaattttctctgagatctaaccgaactttgttaagtggattgggacaagattataaatgatatgaaaaataacattttgacatttgtccatcaaatttaagaaaataatttgcctatataatttttcgtaatttttttaaagataatatattctaccctcatgtggttctcagatttaaaccataatgaacaggaaaaaaaaaaagggaaagaatgcaactgagtgctaaggcagaacattgtggcagaagaaattaatgaaggtggagtatatactgaatatcaagtgcagaatttcatagagcaaacaagataaccgtctatatttttcacatatgcaggcaaagtggattttgcaattgccagttacgttaaatgcactaaataaaactcctaacattgatactataaggcacccccttaagttttccagtctgcaactgtgcataattttaaaatgtttttttgaaaaacattttaagtttaaattggattcccaaccttatttttaaaaagtcacagaaacaagaatagagagaaatctagccatgttttaactggtagaatttcggacggatatttgttttgtattttccaattttttcaagtgtgtctatgttattatgttcagaaaaaaaaacgttaaaaaataaggctattgcaatggtttggtgaatgatgatacatgtgttgctttgtttgtaagtctaggatagtctagcctgagagcctgctattgagtagaacttgtagaatgatggatcatgaaccaaattgaacaaagagaagcttcactctgggaaatctgtacctaccaactaggagtcaagataggaaaatataagggtataagatagggaaattactaagaaacagtccaggaattttagtccagacaccttgcatactactgagtaaaaggtgagtctttaaagaatttgcaccagttggatacagtctgaactaaagcagttgctaagactgaaaatgtgcaagccatcaccaaggtagacaagacctgattcactggatatgggaggttaggaatgcaaggatttagagatgacactgaaggtttgaatatcagttactgggaggactaacattttttctttaaataaagatggaagatacaggaggatgcccagatttgggaagaaaaatagtttgtgtagattatcttgaagtggagtggccatggaaatatccaggtatatatgtaactgtgaatctgaagatctgaggaagtctggacttatgatgaaaatttggtagttgtctgcattgagggtagaactgaaaccatgggaaacaatgaagtcatgagatagtgaaaggaaagaagaaggtggaggagcacattatggaacatccagttttagggagtaggcaaataagaggcagtgaaagaggcaacaacaaatcagaaataggcagagaattaagaaaacacaggcttatgaaggtcactgcaggagaaacgtttaaaagttggtggttgaggtaaaattctaaacaaaaataaaaaagcctaaggactggggtgaccatttaatattggcaattacgtttactagggatttaaagaaaaatagatctggtaaaatagttgagcaaagccaggttgcaagcattgagtggatcaaaggagaataagtggtcagagggtcgaccactcctccacatttgtcagtaagaagaatgaaagcactctgatagtaaactatagaggaggaagatagtagattaatagttgtatagtaatcctaggtttttacctattaaaaactagcatgctgggtttctttttgtcttttctatcattgtgtccagccaggaaggtggaatctgaaaatggaatactgtatggtatgcttcgaaaataccttaagattgtcagcttctatacagagatttggagactacatataacactaaactctcagttatgtttcttttatcttcttttaatcagttttttttcagcttctttgcaggacagaacactaaagctttatgacttaactaacacacagtgcacattatgatgaggtgacataaacacaaatttgaatttatttttttatgacttaaaatctttgtgtaatagcaaagttgctttacacatacaaattttattatgattggagtaatatcttcacaatttcattactcaggcccatataacctattatgctaaaatgtgttatcgataagctaatatctattttagtgcttccttttggttcagctttgaacaattgtcacatggaatggagaaaatttgactagtagaagtttagagctggaggggaacttggtacccctgacataacatactccgtttgcaattaagaaaaccatggcaaaaagagatagatattactgatttcaagttgcttacttgtaaagttgccgaaaaatgtgtactcatgaaatactaaaacagggagataatatttcacactagagtattttttaatatattataaaagtttcagtggataaagtggtgttagagctattctgaaagaagttgtaggaatctgaattttatgacacttaatattgagaaccattaaatgttttaagcagtaaagttatatgatgagttacacatttaatggtgactagttttgggaagacagaaattttatagtcaggtatgccctactaaaacattattgtattccaaatatgcaatgagggtctaggctagaatttagaactttaaaatgtatttctttttaaagtaacagcaatattaatccaagtctaaataacatattgtttttattccatgtaactagagtagcagtatagtaaaaacaacataataaaatatttttaaatattagctatgtgctagatgcctaagcagattgcctttaatttatccaacaagcctttattatcctgaaaccttcccagcatctattaaatttaaagccctttgtccattttaactcaaggtacctccacatttctttggaaactgtacctactaacactagcagttgtggacaattgagagacttatgtatcactgttttaatatatgtgaacataaggtacgatcactttttttgtgaagacaattttgtgaaaatataaaagggtgatgaagtagagcacagtgttgatggtgcctgcttcattaaggacagcacattcctgggggtctagagtaagaatgcagtggtatgggaagtataggcacctgtcctccatcatcatcatgaatgcctctctggtccatgtctcacctgtcattatagttctttgtctcaatgacaagtacctcttaactacatatgtgccactgttggcctcatggaaaccatttcaatagtggtacgtgttccaagagttcccaggcaaagctgttctgggctctgtgtgccttgcgtgctgaaatatagataatagctttgtgcttttttttttttttcctaactcaggaagttttaagtgccacattttgtaagatagtggctgatctaactatgaggaccttatttctaacccattgatttagctagtaggaatcattatttctatgtattttctatttaaatttttaaattttaaattggctatatccctcccactgttcagttgtggtatactcagaaaaatctaaacattaatcatacaaggtgaataaaagcataactataaaggcaaagttctcaaaatcatataattagtttcagagtcaaatattaaaattatttggattacccagtccttaaaattgtcaactcttttagctatacaacttgagtatagattgcagttgctgtgattatatttgctcctaattataatttttattaaggatagtttggatttaagagaggccacacttttttggtttggttttctgggaagagtaactttgttttaatcattaacagagttgcaagtgtaagttaactttcgtatctggcatttactctaccttaatataaggtagagaaatagcctggcctagtcattgttatatgggttaaatctctcatctgcttctcaaaataatgcatctatctaccatggacccacatttaatgcctatctcatttgaggggtgtgtgtgtgtgtgtgtgtatgtgtgtgtatgtgtgtgtgttgttagaaaagttcttaaaacttttcagtaataagccattatcatagtagaaagaaagcatacttttaagctttgcctcttgagcaaactgaaggcccattttagatctcaggctcacagggtccagggaggtgatatttaataagtttctagaggttaaggccaatggtgtgacctgtgttcagtgactcattgttgttagaaatttgcctccagtgatctatttgagaaccaggctagttttacattttttataaggtcattctccaagacctatgcctcttaaaaaaaggaaaattcttcacggtcatattattatattggaattcaagtgcaggtctctggcctagtgtatatcttctctgccttcaaaaaactgttttctttgtgacttaaaaaatgaaaaatccatatcttttttgactgaagataactttatacttttaacctatatttcagaaagccaatctttagagaaaatgaaatattttaagggaaaactaaagcatagccatgctctgcaaacttttaaaacattagtttcaggctgtgattgctgttttctatttgactttcaagttagttttaattggcataattttactatttaatagttaagcatttttttaataataagatataaaggtgaacaataaaaagaacaaaaataagtttatgttataaaaaataaaattaaagaggaagaattttgtatgggtagggtgatggcaaagtcaaataaaattcaaccacaccatacagaagagctagattaaatcttgaatgctttgtgttacgtgagtagaaaagaatgatcgctctgaatactttataacctctaagaggagagaatgttgctgcagcaatatctgggaaatacaatcagtgtgtctgaagccagcatctatttatcttaaattaatcatttttttttctgagtaagtggatgataatcctggtgctgggtgccagtgtctttttattcatgccatagataaaactagagcactcctatgttggtgagagctatacaatacaaaaggtctcaagctgtaactcttctgtaagattatagacagctttatagatttgcaacatgattttgggattgagaatcagtaaataattgtatctaaagtaaaatcttgtgcataatcaagtctattttacctttctgccctcaggaaagtataaacaaggtattctaaatataaggcagtaatttttcttcttcattattaaattctctggtcaaagaagttcctacaactgaagtggaaaagccttcactaaattgtaaactgtctggttgctgttagtgtgagccatagggtgaagagcagcatggtgcctctgatgcagtgaacctcaaatgacaccacattgaaggcccagcaatcaggcttacattcaaatatgtactcactttatctcttctgaaaagaaaaccaggccaggcacggtggctcatgcctgtaatcccagaactttaggaggctgaggcgggcggatcacctgaggtcaggagtttgagacccgtctggccaacatggtgaaaacccttctactaaaaattagccaggcatggtggcatgcgcctgtaatcccagctactcaggaggctgaggcaggagaatcacttgaacccaggagacggaggttgcagtgagccgagattgcaccattgcactccagcctgggggacaagagtgagacatcatctcaaaaaaaaaaaaaaaaagtaaaccaggaaagtagtctggatttttttttaagtaggtcttctttcctaggcattgtcagtaagtattatattatcatcttgtctagggtagagggtagagtagcaagaaggaagtgagatctcctcacctctaaattgaacagtgtactgggatttaaccatcttctaactctcgcattatgtctcaagaatatatgtggatatacaaatatttgtcagtagacattagacattgtgattaaaagctgtgaaaaatatgtaaaatacaatgaaattttggtcctcctggaaaagcatctaaaaagaattcagaaaggaatggagcaatgactcaacatatcagatttagttaagtggtactgatagcaggatgaaagttaacctaacttaaaaattaggtaaggctatgtggcttataagagttaagaactcaaccattggtaagttatgaaatcccttttatagactatgcatagggctcaaggtgacccttagtcacactgacaaaatagtcagcaactgggttgaaatcccagatcaatatagatcttcaattggctaagaaggtaacctcaaaactgtttgtagtgatatcatttccttcttagataaaattcttttaactctggaggatttgtaatttatagtagaagtatctaaaataactaaatttggcagcatatttttgtattaagaggaggtgtacacacttggtattttaaggatttctaatgtgaaagaatctgccttactaagtaacaggttagctttttaattccatcttaaaatgcataactgagtgatttagatctataattttaaatagaaatcttaccaagttttatataacattgaaacatttaagattttatgtatgtatacagaatctattattgcttgtcatctatctatctatctatctatctatctatctatctatctatctatctatctacctatctatctacctacctacttacttaccaatctaccaacctacctacctatctaccaacctacctacctatctaccttccttctgagctatttgatttgtcagccaggcaattttaaaggaattgtctttaaaggaaggatttttaaaaattgggccaatgatcaattgaaatcctcttatactattaaaatatgctagactaataatttataaattgattttaaaaacttgagggtaagtcaggttttgaatttgctaatttgacaaatttatattaagctttaaaaccaaagtaaacccatgaatttttttatgcataacagcttctctcaaggacacagaaacactttttattgacagtattgatttgtcttctcccttatgagaatgtgaggagatagaagtcaacacacatagttagttaagagtgagtgcttcctgccccaaatgttcccagtctttcagcacagttgcttctcttagcagtggaaggtggccatcttcaatatcagtaaccatcctgacctttctgagaccaaaggccaagtagcgatggaccaacctgagaaattgctctcatgtattcatgccaagtttccactcctttattgttttatatgacacaggtaatatacatttcttatagaacatttagaaaacaaacatagccaacaagaagatgatattcacttgtatctcgtaacccagataaattaaccactaccaatgttccgtgatgctcctctgtaattgcaattgcgtacagatgtgtttagtttgaaatataatgagttttagttaacaggtatccctgataatgttgcacactctcactcacacagtcatgcttttttttttctgccttgtattataattatggttttctaccttgcttttaccacttagtaacatgttatgaattcctgttattagtaaaataaaaataagaactaaaagtactttaaaatatatttaaagacaatgtaaaagtgtataaaaatcattaaaaagagctgagcccagggcctcatgcctgtaatccagcacttaaggaggccaaggcaagtggattgcctgagcccaggagttcgagaccagcctgggcaatatggcaaaacctcatctctacaaaagtccaaaaaaaaaaaaaaattatcaaggtgtggtgctgcacacctgtagtcccagctactcgagaggctgaggtggaaggatcacctgagtccagggagattaaagtttcagtaagctgtgattgcttcactgcactctagcctgggcagcagggcgagaccctgtctcacatttaaaaaaaaaaaagcataaaaaagtattaaagcgtaaacaataaagcaatagctttatgtttaatggctgcataaattccaatgtacaaatgcactttgttaaataaccttccaatcttcagcattttaaattgcctacttttttgttaaaataagcaacagtctatgaacatctttgaatcttagctaattcattttacaatttaagtaatttcagatgtaaaatatgtggcaaaatgattatgtattttgtaagagtttgacaaatattttcaagttatcctacagaaagatgaaccagtttatgcccaggagttgcttcttagttaaaaccttgataggataaactgagaaacccaccaaaattagaatgcccatctcagaattaaaaaaaaaaaacattaaaaaacagactaaatagatactagttttgttatcagaaacagttgagtttaaggtgtgaggtgctcttatgttaattctctgaccaaacctagcaaagatcctgccattacatcaaagtgttgcactggggttgtcagaaataccaactgtatggctgttggtttgcagccaataaacaagcaaaaaagctcaacatcactgatctttagagaaaattaaaaccacaatgagatacaatttcacaccagtcagaatgacaattattaaaaagtcaaggaacaacagatggtgcggagagatacgaacacttttacactgttggcgggcatgtaaattagttcagctattgtggaaggccaagaaccataaataccatttgacctagcaatcccattactgtgtatatacccaaaggactataaaacattctattataaaggtacatgcacatatatgtttactgcagcactatttacaatatcaaagatatggaatcaacccagatgcccatcagtgatagattggataaagaaaaggtggtacatatacacctggagtactatgcagctataaaaaagaatgaaatcatgtcatttacaggggcataaatggaattggaagccattatcctcagcaaactaacacaggaacagaaaaccaaatgccgtatgctctcattcataagtaggagctgaacaatgagaacatatagacataggaaggggaataacacacactagggcctgtgagacaggggagggagagcatcagaagaaaatagctaatgtatgctgggcttaatacttaggtgatgagttgataggtgcagcaaaccaccatggtacacatttatctctgtaacaaacctgcacaccctgcacatgtaccccagaactttaaaaaaaattgagaactttttgatgatcatataccatgtaatatcttttgtcgataaattctcatatacactggaaatctccgcttcttgttacagtagcctctaccagagtaattaaaatcatgtaggagtggtacaacctttcttaacacagccaatatagatttcatggtataatagttgagtacttaggcaccagccaataatccatccctatgaatccaaggaagattgtccttcatccattccaaagaaattgacctttatccagtccaaaagtcatttaattttgtctttaatatttctggtaatatagtgtccattacccatgtgaaaaattagtgtgcacttaacatccattacgatggctactatcaaaaaaacagaaaataacaactgttgacaagaatgtggaaacattggaatgcttgtacactgttgatgggattgtaaaatggtgcaaccaccatggaaaactgtatggaggttcctcaaagcacaaaaatagatttaccagatgagtcaacaatcccacttctaggtatgtagccaaaagaatcaaaagtagggtctccaagagatatttgcccacccatgtttataccagcactattcacaatagctaagaagtggaagcaacacaactggacactgatgaatgaattgatttaaaaatgtggtgtgtgtatgtatatatatgtacatgtgtatgtacgtatatatacatatacacaatattattcagccttaaaaaggaaggaaatcctgtcacacactacaacacgaatgaacctggaagacatgccaagtgaaataagccagtcacacacacacacaaccaaatactgtttgagtccacatatatgaggtatctaaattagtcaaattcctagaaacagaaagtagaatggtggttactagggaccaaggagaggggaaaatggggagttgtttaatggatataacatttctattttgcaaaaaaaaaaaagttctggagatgtgaatgtacctcacactattgaactgtaaacttaaaaataattaaaatggtaaattttatgttaggtggtttttaccacaattaaaaaatggtgaattacatgtaatgtcaattatattttaattttaaaattaaaaaatagtttcccataaatcttatatagagttttaaaaacatgtttaattctctcacgcctataataccagcactttgggatgcttaggcggttggatcatgaggtcatgagatcgagaccatcctggttaacacggtgaaaccctgtctctactaaaaatacaaaaaattagccaggcgtggtggcgggcgcatgtagtcccagctactccggaggctgaggcaggagaatggcgaacctgggaggcggagcttgcagtgagccgagatcacgccacagcactccagcctgggccaaagagcgagactccatctaaaaaaaaaaaaaaagaaaagaaaaaaatgtttaattctctgtgtgcggtttgctaaatatttttaagtgttattatattttcttatgtagactaaggtttcttactgtagttgtttttacatggcatcaatttcttcatgtttttgatataaactcttttctcgctactaatatatgagatccatattattctgttgaaattcaacataacaaaatgtatcttggataaagtctagacataggaaagaagtttattgtgttaaatactagaaacttaggacaatttttcaagtcatacccgtcctttttgaaatgtaatttggaaatattcttaagatccacataaacttatatattttcttatctacagggtattttatccattaaagatgctacattagttatatagttgttatacacttaactactctaagacccttagcaacagtccatgcataattgcttggagttttaaatgctaaagaaaaatggtgaatttgcactcactaggttttgtagtgaattcttgacatgcatagccaatgcaccatcaggctaaatagtactcatgaagaaacagagataagacacttctggaagtgtgaaaattctgatttgagagaaatgtatgcagaattgatatttatagtacttattttctggctctaatatgttatatattctgctcttggatattggctaattatcatgtcagtaaatgctgtatctggaaaacattttgtcaagtgaataagacttttcatatttctggtaaaagaacagtatatatacttttatacatgtttccaaagatcaaacagctttaaaaaggtgtacatctggctattatttaaccagactgaataatgcatgaaagaatgtagactctttggaataatgtgttattttaattcttacatgactctgttacagagcaagtttatttccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttcattgaaaagaccatggatttcatgtaaagacaatttggggtttaaatttggcctctatattttattataattggaacattaagctatgaatgaaatcttagacaattttctaatttaaaaaatgggaatagatgccaatgcctacctaaagttgttgtgtagagcaaaatttgataatattaagtgtctaatgtaaactctgacatccaataaaagtttcttccttctccttcatttcctacagaaagatttgaattttttacttttgtttccccttacttttctttcatcttgaaaaaacacaaacaaacatgtcaagtttataactgaagacagataagaaaaattttgaatagtaccctgtttataatcctgagcttttagtggaattatttctgaggattaatcttgtcctgcaaatttcttggtttaaaaataatatatatattcttatatatacatatatgtgtgtgtgtgtgtatatattcttacatatatgtatatatgtgttcatacatatatgtattatgtatattctcacatatatgtatgtatggcatagataaattacaataaaagaatattctaaatgttatatataataaaatatataaaatatatatttttatatattctctatatataacattttaaaagttattttattatttaattgtaatctcttatctatgctatccatatgattctgtagaaactcagtataacaaaatataacttggacaaaagctaggcatagaatacaatttattgtgtttaataccagaaacccagtacagtttttcaagtcaagttttttccatattagaataccagttaaaattagtgtgaggctgtgttattattaggatatgtatataactatatgttaggtatgttattagaatatattatatatattattattatgatatataatgtcccttgtatgtaaccaatctcacattgttgctgttccttcccccttgtgggcacctttccccacttggtcatgctctgatatcccatgcaaggtagctcctccttcccaatgtcctccttcaccttctcaggctctgacacctttctgacactttcactgtgtagttccacccactggataacactttctcagcctgcttaggttcccacacaccgcactcggctttcctcttttgcatatgtgtacctccctgctcttttggggctctgtcttcccatgccaagctgccttcctctcccactgcatggtcaccatttttaacctgctcatgctctgtcagcacactctaggacacccattcacatagccctctttacctttgtcaagctccagaatcccattttggtcattctttctcaaaatgtggacactttccacccttcttggtttctgtcaccccgtaccaggcctcttgctgttgaatgctcttgctatcctactccgactctaaatatttcacaccaggcaattcctccctcttttggcaggatatcctccgcacccaacttcaaatttaacacccctcattgagctttcctcttgcatgaatgtcctcatcaccctgctcagactccgttaccccatgccaagctgcactcacatgcagattcccttcctattacactgggttccaaatcccctttgctgtgccttcttcctgtgtggatgcttcattcaccttgcttagacctaaaaccataaaagctgcagaagaaaacctaggcaataccattcaggatataggcatgggcagggacttcgtgtctaaaacaccaaaagcaatggcaacaaaagtcaaaattgacaaatgggatctaattaaactaaagagcttctgcacagcaaaagaaactaccatcagagtgaacaggcaacctacagaatgggagaacatttttgcaatctactcatctgacaaaaggctaatatccagaatctacgatgaactcaaacaaatttacaagaaaaaaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatgctgttggtgggactgtaaactagttcaaccattgtggaagtcagtgtggtgatttctcagggatctagaactagaaataccatttgacccagcaatgccattactgggtatatacccaaaggattataaatcatgctgctataagacacatgcacaggtatgtttattgtggcactattgacaatagcaaagacttggaaccaacccaaatgtccaaccattatagactggattaagaaaatgtggcacatatacaccatggaatactatgcagccataaaaaatgatgagttcatgtcctttgtagggacatggatgaagctggaaaccatcattctcagcaaactatctcaaggacagaaaaccaagtaccgcatgttctcattcatagtgagaactgaacaatgagaacacatggacacaagaaggggaacatcacacagtggggcctgttgtgggatggggggatgggggagggatagcattgggagatatacttaatgtaaataatgagttaatgggtgcagcacaccaacatggcacatgtatacatatgtaacaaacctgcaccttgtgcacatgtacgctagaacttaaagtataataaaaaaattaaaaaaaaattccaccatcccttaaaaggctgctctctccataggcagttagcgctaccaacctaatggctctatggtggaattgtccatgaagggaaaggaaagaaagggagaggatacagaaaagattattagtgacttgctctctattttaaatatttaattgcatttataaaagtaaatattttattctagaatagcttcaggtttgcagaaggcttgcaaaggttgttcagggagttctggtataccctgcacccagtatacctaagatcttccattggtgtgatatattcatcacaactaataaaccaatattatggtacattttgtatcaacatccataattgactatgatttccagtaacatttttaaagaggagaaaaggatttcatctgtttttttgcatttatcctgtatcttacaatttccccccctgaactgaactgttattccaatagaggaacactgaaattactggtgtgataggaattccctaggatattgtcctcctctttatagatttttgtggggagttgctattgtaacctataatctgcagcccagcattccttttttactggacagataattttgtgagatgaggcctgtaaagtgcttggcattgtgctcaggccactttatttctcaggcactggagcagagtgctaggggactataggtttttcagtgactgtaaaagaaaaagtttgagatgaggaaaagaaattgtccctggaacctatttttaaaacagcaaaatctataataaatgaataaatgttttattaaatgtccatgaagcataacattatatcaacttcatgagctattaaacttattagtcacaaaaatgtcattatacttgaaaaaatatctgtaggttagattttcttcaccaaaaatctcgagttggcataaagtcattgctgataaattagggattatcctaattaaataaataacatatagccaaaaattttggaagcaaaggggataataattatgtccatttttttcttagaaaaatatatattaatgaaagatagtcaattttaatataccgttatgatgcacatgaaagtaataaaaatgtcccacctacaatgtagtgagtgatcagcaaattttacttctctttctttcttctataaacaaatattttgtatcatggggaattataagataataatgtagaaaatgcatgcattggcaaattccaacaggagatttgattatttgagttcattttgaggggattccatagcataggatataggaaaaataaacttagacttgtagtcagaagccctgggtgactttctcctctgccacttagttactcattaatgttagaaggctgtgtgttgcctcagagctttgatatcattatctgtatagtgggaatgctaatcatatctgtgtatcaacactaaagtactgctcatgaaatcactcaatgaactgtcaggtctatcacaatattagatgaaattgctggtcattattcttgttgttgtactactatgtcctttctttagaagtatgtcagaaccagtgaggttgatataattagaacattttaggctcctcatacagctttcaatgtcaattttcagaaaaatacagattatttaaataaacagcagcaggagatagtagcgtgattgactgtattttcttcactgcccattgtgataccctgtgaaagtatatccacattttcttttttttgttttgttttgttttttgagacaaagtctctttccgtcacccaggctggaatgcagtggcgcgatcgtggctcactgtaacctccacctcccaggttcaagcaattctcctgcctcagcctcttgagtagctaggaccactggtgcatgcctccacacctggctattttttttttcttgtatttttagtagagacgaggtttcaccatgttggtgaggctggcctcgaactcctgacttcaagtgatcagcctgcctcagcctcccaaagtgctggaattacaggtgtgagccaccgtgcctggccagtatgtccacattttctatgtctccttgatttattgatggttccaatgaagagggggttacctgaggcattttggggcagacacctcatgatagatcccaccaacttctttctgcctgctctcttggaagatatatacccatcttgaatgtttcctgcttactgacttgtcctagggacacaaaagtgctaagtgtatacacttttatcataagttttaaaaatccacaaataaaattaaaaaactattaaaaaatttccccttcaataattatatgaagaacatgaattgctaggtagaaagtcattataaaaatacatatacatttaacagtttcattgttttccaaaaaatttagcgcaattattctgaaaattaaaagaaattatgattccactgcttgaaatcctggcatttattgaagattcctcaaaagaactgacccatttgtattggcagggtcataaaactgctcagagttttgctcaggaagcatagtttgtcctgtgaagcttcttaagggtaacttttcaacacattataaatattttaaatcaattggttgaacttaatgtcatttaagttgtaatgaaagctctactcaaatgctgtgccctgaaaggacaagataataaataaagatatatatttttgccacttattttttagcaagtcctgctgaaatgggagaatgttttaaattacaaagcaatttaagaattctaaggagggcatatagattcataacttgttgcatcttttgtaggatacagccagcctgtacttcatgatacaaaacattctacaaaaatatgtttgagaagtcaaatgtctaaaaaaatacaatagacttttttatggtatgggtataatatttcacttttgggaagctatcaatgagtaccatttcttaagcatcatccctgctggcagtgcctttgcctcctagggttcaggtgttccagtgagtgggttcagaccttcacaggcagcaggagaggcaattgcctgcccattatctcctgggaaaaagagaagtcaagccatgagcctccctttctcataggaacgttgtctctgtctgatcctttccatggggacttgatctgaattctgggtggcttgcagttgttaagtcacttgaagtagatgcctgtaatgttctggagcatggtgaagggaaaagtgagtgggatatgccaggcttatgtatgtggctgcctgtgggaaactctctagctgtcttctaaagcagcactgcaagttgccttttcttattgctgttctcactgcctgcaattgaatgaggactgaggaggagggaaggatttggaaagaaagagaataagttgggtaagggggtgctggcagtgacggtgacaatgtgtgaactgataggtgtctgagagtcctaggaatctgcatgggacccctcagcattgaagagagaagggaggggagaaaagactgtgaatatgctgcagtgagaattgtcagaaagcagtttgttttttggcttggctggtgctgctacaattaatagcctaaaagtgtcacagctacctcatgagggctgacttttcttcccttgctcaaacctccatgggtatctctaaatcattgtcagtcaattctggaataaaattgtgaatttggcctacagaaggtggtttagggcatgacttaaaatatacaaacatatctattatgtaaatgtcaagaatcaccttttccatgtgagtgtattgaaaaaactgttatacaccataattccctggtcacaatagctcctgaacaagtcaaatctatatcaagtccaagtctagcgagcattgctaagtgctcacattaattccaaagtacagtttgtatttacttaaatcctactttaaataaaagaattaaatgaccagatagatatgatgaatctatatgtgactttactcgatattttcagttgtttttctgtgtgttgccaataattacaaatggtgttcataaaatcccaatatttccaatacggatatactttaaattttaaaatgtatttcttgtatatgcagtaccatggaaaggaggagaatataatattgaatatagtatatttaaacaatatcctttggccacgtgcaaggttattgtaaacttgcagaaattatagaattaaaaccttataaccatctctcacaggtacttctgaaggagaaataccaaagtcaaacattcttttagaaaaatattggcttcttttctttcaaaataccatttctaactaattataaaatcaaaggaaaccactatagttttaaaagtatctgttttggctagttgaggaaagtcagttattattcagctcacgtaacatagttcatcttatatatgtagcatttttattactgttctagtactgattttagttcattgcaatttatgctatttgcgctctatttgaaacacttttttacttcatatagaagcaaaaagtatgaggaatgctggagcaccattggcttttggaaccattctattctgttattgtaatgaaattattaatttaaggtggaaatccaaaatgttctgtatggtatggtgctagtacaaacggtcattgactcctgtacaaattaagctgcaacactgtttagaaagattgtgggactgtaagaccaactaattatacttatccattttctttttatcacagtgattttcttatcagagttcttaaggcaatgcaactatataggaaagatcttttactagtgctagttgaaacttctgaaatagccttggttgtatgaagaatttttttaagtgagaaccaaagccagatttatttttatgggaactaaaaacatggatactcaacctcgattaacctcatgatagtttaaatacaactaatcttggtttcttgtttatcgagtcattttctctacttaaagtttattaatattattgtcattactgtttatagttatcgctaaatacagcccacaggccagttggtgctgaaagggaagaccttttatcctataatgtttaattacttctttcagcttgggaaagtatgggcagaaagatagtgaactttagcataagaacaattgaacaaagttctatttagtctgatggttttcctcaattgtaaaattgattctcttgatcaatagtgtagagagaaaaaaaggtaatgctgcagagaagtgaggtggaaaatggtaccattcaataggacttgacagcagcaccacaatcttgtagtggcatagattccaagaatagctctgttcatggccactagtaaatacaaataaaataagcaaacacaatttaaattattttccactttgatttagtcacatcatttgttttgtccattattttgacagagtcctctaatgaagcatttacttggtacaaagaattgtgtaagggatggcagatatattgttagaattttctatgtaagtctagttataaaaatgcaataaataggccggacacagttgctcatgcctgtaatgtcagcactttgggaggctgaggcgggtgtaccacaaggtaaggagttcaagaccagcctggccaatatggtgaaaccccatctctacaaaaaaatacaaaaattagcctggcgtagtggcagatgcctgtaatcccagctacttgagaggctgaggcaggagaattgcttaaacctgggaggcagaggttgcaatgagccaagatcgcatcactgcacagcctaggcgacagggtgagactgtctaaaaaacaaaacaaaacaaaacaaaaaaccaatacatatataaatatacaaatacattcagtgaagtcatagtgcatatatacagtagtgagtgaaatactcaaaacacaaaatactcagtgatctccatgatgcctcttgcacaggtataaacagcctggacagtaatttttcctgagaatgcaagaatatgaacttagatgtacttgagattcagatgtattatactgacaaaggtgtttgacaaattatctcctgactgatgccacaattcaagatgggataaaggattttctaatagataaaggtcaccaggagaattttaggggtctgacagggggtgccaggctcagaatcagggcatagatggtgggaaggaaggcggcaggtacgagatttcagtggggaatggcagtggtttccagtgcagtgagctgagtacaattgggtaccacccttctcagtccccaggtaccatgagcatgtggcaaattgtaaatcactagttggacaaggacagcttctactattgggatctatggatgtgctcactgatggctggacactagaaaaggaaggtgtttgcttactggcttgagagaacaatgagaagaagaggaagaaaatgtcagtaaaaaagaaaagcactgatggaagcataagacctgaagaggctacagaatgcaggaggtcctatggtggccaccccagaaagaatgagcagcagcctgaatgctcagagagaaaggaaaatgggacagctgcagatggcaactcacagattgcagcctagatgctcgctggcctgctactctatccctgacttcacatgtacaatagcctgtgtcctctggtctccatggtgcagagaggtcaaagtacactggtctggtttagccttctctacaatcccaatttttctgagagcattagaaaagacaaaagaaatgggagtgctaagcatttggtatatgagggtgatatggtttgcctttgtttccccacccatatctcatcttgaattgtaatcccataatcccacatgttgtggaagggacccagagggaagtaattgcatcatgggggcggttagcctcatgctgttcttgtgttcttgtgttgttgatggttacataagaggcatttcccccacttcctccacatttctccttgctgcctccatgtgaagaaggacatgcttcctgttccttccaccatgattgtaagtttcctgagacctccccagccatgcagaactttaagtcaattaaacctctttcttttgtgagttatccagtctcaggtatttcttcatagcactgtgagaacagactgatacgtggggctactaaatcaacatatgtacaaactttaccttatctagcaccttcaaatcaatgttgtttaaacaccacttcttgacctgttcctggccctttcatctatttcttcactatctcccataagcttgatggtgaataaagctcattttgtgttatcattgactttctggctctgtccttgatttcaaacattgcatctgatgcattccagatcgtggaaccctatcccagaattaaagttaagtttgtcttagcctttataagtgtggagtaggcagacaaaataatacgatcaaagacttacaatcagtagtaatgatcaaacaggtctatgaaggaagtttagaataaatagctaatgggttataaaagttctgaatggagaaggcaatcttaatcatgtatagctatatcactgaggggaaatccaaatgatcctggctttgaaaacggccttagaaacttctaagcctaaacaaagtcaatgacatattagagattttctggtacatttatgtcctcatctggttctgtattcaaaggcagcaccatttcaaaaaattggatggaagcgtggattggggagtgcagaaggagctgagtgggatcctgtgagagatgataatagtgcataagtgcatatctcattttccagaatcacattgctcaaaatatcagctactttatcagcaaagctagaggtcctggcagtggtggtggtaactccacagcttatgtgctatggactctctctcaataatctccaaaaatcgactaacaatgagaattttactagaaaaagaaatgactttaatttacagagtccaaagaccataggtcactagtctctgagcatctagtatatggagaaccagacataccaatcagacactctgagaccccagcagcactctcagattgcagcctgcatgctccccagcctgctactctgtccctgacttcacatgtacagtttcccacagatacctgtgtcctctgtctccacagtagagagaggtcaaagtaatataacagaatccagaaggcctggccttcagcatcactgtgtccctggctaatacaaaggccatgtcacttttccttgctggtcctcatttttctcactttttataaaagagattgagtctggatgactcctcacatctttcccagcactttgaatttttaaattcataaatcatttgagaaaattttgctcagttccatctgtacctgtatgatgatgctgctcacttaaactcttcctctgtctcatccaatatccaccaagtgccgtgtgactcagtttcctctttgtatcagtgctggcttgggtgattcctgcctcctctaagatggtgaaatatagaacaaatagttcctattttatttgtacatttcctttttgtgaagtcagttttgactgcaaaaccagcaaatcttctgtgaataactccttttgctttataataaaataggaagatttctgataacacaggtgattcaagattgctgaaaggtttaatgatatatgcacttgaagtgataaacgaattatgttgaaaaagaaaatacttagaagtgaatgatacagaattgtctgaaaaacattgtaatctcagccatcatgaataaattcaataattttactacttctaaaaaatgttctacaactgatgttatgtatttgattagagaaaatattccacaacatttcaaaaccttttaactcacataatatatcctactcataacaaattttagttttgaaaactgcttctaaacaagtcacttaacctccctgcaactacttttcctcatctgtaaactgcagagtttgaaatagctaatctctaaagtgccttccggtttgaaaatgttatgattcagttttgcttctcatttattgtatacagtgagaacaactattttagtggctaggcacaatcgaaaacctaatgataatgacttcagcaggggtctaattggagcttttagatataaattcaatttatgctaaggtctttctcatgggccttagttggatggcggctttacagaatattattggggttgggtgaattccaaagcatctttattttatagcagtatttttacttttcaatagagtcatactaatttataagttcatagtgtagaaagactttggcaatgggaattatttttaaatgaaaaatgatgaatatattttgcataggttacataatttcagagccagaagcgatcctggaaaatttatgcagtattaccaggataagaacaatgctaaaataaggaaatacatgtacctgattcattaatcagaagatttatatggataattttctaacagaaaggaatattttgggattaaataataaaagtgaatatgtttccaagataaaacagttgtccccattattcctaccagatgtcatgtggagaaataagcagcaaaacagaaaataattttgaaaattgtgtagataaatatttttcagattatattttgtgaccattatgtctgcaaaaacctattgctcaaaaatgggcactgtattcaaataaatttgggaaacactattttaaacaaagttaaatcatattttaattatagaacttttagaagccttaatattttagtgtgatatttactgttaatttccaagaggatacagtatacacagttttaaaaataaactcattaactagggaactttaaaaatttttgatacagattaaaatatatataataattataaagaaagagtactataaaattttaaattctgatctatgctatcttggaaaacattcagcttaaaatatttgtagttgcagttacttgtgcaactatatatgtgtctttgtatttacatatatgtgtttttttttttaactaaaagacaacttgggaacatattcagaaaaacttttatgttaatgttcgtttttatgctgctatttgtcttcatggtgttccagtctgggttccggggttatgtctttagtttttgccactcatttgggctctaggtgcacttttaacagtttacttttatctgtactttactatcttacttcactctcataacctcaaactgaatttggctcaacctaatttatttatccattgcccacctcgttttccctccactctgaaaaccacataaaggcgttctctgtgcagcatgccgtatttccattagtagtgctgcaacacaccctgccagaagcgtaggaccattctgaactcctttctttctccactgattactgccaaatagttaataagtcttgttgattttacctgctaatagatagctacctgaaaaagaatgaaactggagccttttctagtatcagatacaaaaatcttctttttttctatctctgctgcatgattgtaattgcctcctaattattcatcacatatacttttccaagctcttttttctttttgtcacaatgcatatttaaaacacaaatgtgatcataccttttcttcccttcatagcctctcatagcttcttcctttgtagaaaatgccaaagtccttactatggcctacaaggtcgtcagtgacatttgcactctaatgctttctgatgccatatcccctttctattttttaaaaattaactttatagaggtgtaattaatatgcaataaatgcaaccattttaagtgcacattttgcaattttgacaaatttataactttatatatttagggtataggacatttctatcacaccagaaatgtcccttgggctccttctcagtcaacttcaaactctaccccaggcctttctggtttctatgattcagtgtatttttttttccttcagtttaagtggaagagtccttgacatgttcatgcaatgcagggtcttccctagtgttgtttcctctgcctgggatcctcctctctgcctctaatgccaaacacatacccaattgcccaccaactcttatccatccattttcaatttaaacatcatttcctgagtcatttggaagagtgcctggccacatataaagcactcaagaaatgttagttattataatgaattataaattggtagcttgaaacctattgggttttcctgcaataaaattatagaaaaatggataacagtttaaaataaaaatactaatttgcatctattgagatgatcatatgatttacaaagtgagacagttttgatgagggtatattgttcattctgacatttgctttgaaaccagaagagctctctgtgtttttctttagtctgttattggtcaatacattttcttagatgccatcaaaggtagaatttagagaaaaaacccattagatcaccttacagataatatcttctgtagttgtagggtgccttaactctgtgttcttaatgcacaaaaaaaggtctatgtttacccagctactgaactgttatgtggaagagaaagagaaagaaaaggaagtaattactttgttggggcttatcccatccattatcctttgtctattattacatatctattgttttgatactttttgctatttttaagacaagatctctctctgtcacccaggctggggtgcactggtgccatcatagctcactgtagccttgaactcctgtgctcaaactcctgggctcctcccacctcaacctcccaagtagctgggactacaggtgtgtgtccctgcacctgaacatttttaatttttttaaatgatctattatgtcattgtgaaggctacattgaccaggccatagttctggattaattctcccaaagccacatagatgtgagcttgctctctaattaaatatcaagaattattttaggaaatcttcttggtgggatatcccttctggtgattaataaatcataaagctcaaagaagacagttgaaggagcagctattaaaccaatgtgatcctattaaagggaaactgagaaaaatcgttttagccagaatttgacattaaactttgtaaataaattaaaaattttaaaataatttttttctaaggaaattgaagaaagtctcatataataaagctggatactcttccacaattaaagataaaaaagagaagaagttggaagtgtgttatgttagtgactgatgtgatttgtatttatgtgctctccaaagaccttgtgtagcctggaaacattcatttgttaaaatgctaaaaagtaaaatatttattgtttcatataaaatcctctatgagatgaaaataaaggaagattatttgctttaatcataaattgtgctataatattttactctgaatatttgtgattgtactgtttgtaatagtatcatcagttatgttgattttagtcctctttatttaccttgaatcaaaatttttcacatctcaaatacatttctaaaccatttatttcagttgtttgaagaaagctagttaagctgctattttatcccttggtttatgattttacaatttcttgtgtttctactgacgttttgccatggtgtggccctggcaggatttgtttagggagtgtgctcaaatgagaataagagggaaagagaaaataatgcaaatgctgctgaaggctttcatacaaaccaaatcatactcaattactaaaaagaattagactggggcttgtgttgccaaaaggcatttaagaactcaaattatgtaattaaaatgtttatgttgatcaaattagccagagtacaaagcagtccataacaaaaatgaagttattcaagttaattcaaaagttattaacatgtacaagttagaaatttagcaaaaaaaagaaatatccacctgctacacatatatagacaaatacaaatcactttaaaactcaccacataaagataatttttcattctatttcttttgaaacccgtgtttttcaacatattgggctcctatattcatgcatttttataaccttctttttatactcaaaatgttaacacacccttacatctttttttaaacttttattttgaaataattttagactcatataaaatttgtaaaaatagtatgttttcagtgtacccagcttcttccaatgataacattttacataaccagaatacagtgatcagaaataggaaactgacattggtgaaacattattggtctacactatagcccttatttagatttcaccagtttttatgtatgccccttttgtgtgggtgcatatgtgtgtgtatttctttgaaattttatcttcaatgtagctttaatttgcatttcttttatggtgaatgagttaaatatcttttcataagtttaattacaatttttatatcttttatgtgaattatttgttcatgtatttgcccacttttgtatctggttttcatattctttttcttaaattttaacaattctttaagcattaggaatatcagctctttatttgtgatatatgttgcaaatattttagtttgtcagttttatttagattaaaaaatttttttgaaaagataacagttgtgttaaaatatagttcatataccatatatttcacacatctaaagcagacatttgaatgttttccagtatattcagagttgtgcaaccatcaccacaattagttttagaatattattgtcacttctttcctggaaacaaacaaaccttacagtcattagcagtcactatttccttcccaaattttccaactttaggtaaagaccaacctactttctattgctaaggatttgcctattcttgaaatttctccttatatcctaagacttaataggtctaacagacatgatattttgaagagctataatgtattctatggtaaaatgttgccatatttatttaagccatcatgattattaaatattttggttgtttccaaatttaaccttataaacgatgcatttgattaagttatgactacttttctgttcatttcctaaagataaattttgagaaatcaaattgtttggtcaaggactgggcacatttttaaagcttttgtcacgttttgacaaaaacaaacaaaaaaaaaattgaaagatgttttcaatttgaactccctttgagaatggataattcttgaacctttaccaaaaactataattagagattatttaaaaaattatcttatttgaaagatgcttctaactctctgattaacaggaattcaaattttttataatcacatttattagatattcttatgacagactgaccttgctctttgaccatttataattgaaatgatagtttcttactgattcctaagagcttatatatgaaatatattcacaagttttgtcaaatatattgccaatttgtctccatgttgccttttaaaattttgtttctgctctttttgttctatagatgtgaaaacatttttataaatatattaatcttttgtgttttaatcttgaaaattacacatattatgtatacacctgaaggaaagcctttttctaattcctttatttttattttatccattagtatatgtggaactttttgacttgtataaatattagggggagctctgtgtttccctaattaaacaattgtggcatatgcattctgtagaagccaatggtgatgcatttccacaggaactattcctgctcaaaaaaaaaaatcagtgaaatttgtctaacgtactcttatgccataaatacaaacaattatcataatcatttgcctgtgcttaaagttatttcagtcagcacattactaataatttgctaacttagaatatcaaacattaatcattatattttgtataccttaaaacacatactgaatgtttttaaagatgcagacaaccagcacaccttcccacccaagctaatttcagtgtaatttaaaattgatttgaatctgtatatggaagatgcgcatggcttgttcttaagttttgtggagaaatcagagaattttagacctgcacaacacagtctccttctgtacctgagataaaagcgggagctattttttgtttgtttgtttttcctttctgctctgggtttataattagaatacaaatagtcttggtcctgcaaaaaaaaaaatctagggaagaattattgatataaaatagatttgatttttttatggcatttcctgaatcagaatcaaattgtttggccgaagatgtgtttggttccatcttaactgttgctgacttcagtcattgctgtttgaaatttcccttaggccgaacctagcctatagctcactgcttgcactatcatcctgtggggaagcaaaacaaaacaatactggcacagaaatcaaccttctcccataataatgtccttaggaacaggcctgatagccacattgaaaaaagcatagttgcaccatatctgatgtagccatttcttgcactatgaactctgaggaatttaggctggaccatcgatttgaaaatacatcagtgtcagtgcagtgaggccagggcagtttgaatggtcgtcttcatgctaaaatctgattgtttttattgaatgcttttattttttaacctgttgtaaatttatatttgcataatataaatttgcaatttaatattttatatcctctttcaatatttcctttctgctttttttttttgctattctatcttccgcttaaaaaaaagtaagtattgttgacattaatcagtttcaaggatgataggaaaaagaggtttgtttttctaactagttatctcccctttctaacttcagaatatttgaggatgcaatctcacctctgttatttactgtgagaatttgaggaaattacttaacttttctgattctatttttctaatccgtaaaatgggatgaaaactgctgtcttgtaaggcagtagtgagggttaacaggttctttagctcttacaaaaaagtcaagtgattacatgtatctgacatgttgctagggagttacaatattaagatgaagaaggtagaaagtcagggacttggccctcaataaattttaggaccagtaaaagataggaaaatttagagtctgcgagtttgaaagagactggttctagaagagcaattcattatttctgctaataatataatgcaaaaaatcagttgccatcatatttgaatgtttgttttattattaacttaatggagagccttaagtctattgacctcatgtgagaaagccaagcttctcaaataatttgattgcatctctgtgaatttatttcactagggtgaggaaattgagaaccagagacttggggtgattttcttaaggctttagtgacaagatcaaggctaggtccaaatttccagtagatttatgtaacttagtgcatttttatacttatgccaaaattacttattttctttttatcagaaacactattcagaaaatgagatcagatgttttttcaggtagagtacaattaaaaaaagaaaaaacaattacagagaaagctcttatccagaaatggggctagttttcagcatctatttggaatttaaatgcattctagtgaactccaagcagattagcctgtatttgaaatataaggtcaagtgggaggttataatcagaaagaattagaactccagaaattaaagttaccttgagagtaaatggctgttctatatggaattattttttgttaaaacaattttacacaaaatgcctttataggtaactattattttaaccaaatgtaataatatacgaatgacatgaaggaatgtaggctatattgcgaattatttttgaattgtgactgttacagctattataaccaggagtgtagctaaaaacctagtattatgtattaagacaataagctgatcacacatattaattcgtgctttagaattccaatatagtctatacaagaaaaactagtcatctccagttgcttaaaagacaagtaattctaataatcttgtgaatgcagaattgaaaacgcacatgataatggataatggagttaaagtaatagaaagttcttgaagaaacttatgaaccccttctgagatttactttataatgatttatagattatcttgattggcgtgatggtattatgggtttttatatttgtcaaaatttattgaactatacgctcactttgtgtatatattttactatatatatatattatatcccaataaagtagtttgaacaaaacatcaccttaagttgaacgatgctatattgatgtcagatgctctgtttgccaaactatttttcgccattcaatctccttgttctttatactttgatactttggttgctagaaatgtagctcttgggaaaaaataaaaataatacattcttaataaaagtatgatgaaatactcacttgcaaaatgtccagaacaacatatgacagaattttgacatctatgaaaggcaccagccctctttggatttctgcagcattttcttttgtacaaggaaataatgctcatatagaaaagacactactgaactttcagaggtctcctacgaacggaactgtagtactcattgtattttaatcaattggagttttattctatttttatattactttaaaattggagtttacacattggtaatattaacattttttagtggtaataaaattacatgctgcaaggaaatcaggatacagtagcatactgctttaatttttagaagttagtgtgaacccaagatcatgaaatcacttttctatctctgttgctgaaagcttctgaagctggcaatagaagtagctacaccttcacatcaccagtactcctgattgcccccttgtgtcgatatattgaattttaatccccgtcaaaaaaggggaaccaggccttcttagagatctcattctgttgttggaggagagatcattcagaatgagcacagaattttctattattgcaaaaagcaaaaagtgtttttaaatatatcaaacctattcctgaatggacaaagaaccccactgaagaaggctatcactggccaatggataaaaatgtaagcttaaataagcttgaattcaaatgaaaataatttgaatctgtaaaaagccatgagttcaaaatataatttaaaggaaaagttacaataaaatttgcaatggtgtagttatgatgccaagaaagggtaacttcgatagtagatatttgctttttatttattttatcaactatgtagaatgtgtgtgtacaggtattctatatatgcatatacatatatcctttttcagtgtttaagattgtttcatgtatatatagttattaattataagcaaaatgaaagcaaatacctaaaagaaaaagaaaatataaatatttgagctcatataagctctgcatatgcagattgtgtgcatgtatatgtgtttgtgcatctttgtgtagctagtctatgggaaagagtaaagaggattaaatttgagtgagccaaacattctctgtaaaggtaaaaacaatttataaatgacaggatgttgtagcagatattttcttactaaacaatcctggtatatgataaccacttagaaagatactgtatcaaagggacagccaaggtatatacaagggatcaaggtgatcctttgatcacctctggcggtcatacacattaattagttaacaccacgttttgagataataggttagccaggttccaaaaagaagaattgttggggcagacttgaaccttcattttctagtagataaattgccttgattctcattctgttgaagttatagataaattccacagaagttttgaatcacaataagtgactaggtaacaacacaagaataatgaggtagcattgatcatttcaaaagtagagatcacatgttttctggaaaagatgtgaaaggcttggacttaaaagtcccatggggcagcaaatcaaatcactctggactacacaaagaatcacttggtagtcaagcaagaacaacaataacatttacattcagatagagttctatttttaaattaagtaaaattattatcattctaggaagttgctaaacgaagtatctacttcaaatacttaccctttagagggcataatactagaaataataaattataaatatataaaaatgtataaatgcacaaatgagtaaatgaatgttgatcaacattctactgaatacttgagggtctctatgcagatttccagagcatgctatctctctctctctctatgcaattcgctctttcccagtattctgtcctgcaaacacttgccacctggattccaagtctcctcacctttggaagtccatcagccttattcagaggagtgaacagggggccgatgtaggaatcacttcatttatttcctgtctgacaaggaactctgttctttgttggctgatgtccagtgttttgaaaaaccttgattaatagtttttggtttttcttttgtttgtttcagggagggcaaaactattttctgttagttcttctttgccacaagccagaaaggacatatatgtttactattattgtaacaaaataggaagtcctcataaagtttttctgctgcatatcaaaataagatggttgcccccaaaaaagcacttgtccaattgattgagttgagagctaaacaatcccctttcttcatggtacacaatatatttttttttgtaaagagtaactgacagacaaattatggttattcatgcttggctatatggcaaacatttactttaaaatgaaagaagtgatcctgtaacttcaagacaaaataagtgatcaatatttgttgccagtgataaaattgaagctgtcaaatgaaatcgaaattttggaaaacttgtgtgacatccactgtgagttgagagcttcccaatacttagatttttctgataaggatgtggtgatattaacaaataaattttttattgtttaataaaacatgttagtattggaagaactgcataactcagtgaaatcatatttttcagtgatcaatggtagaaaattatgcaaatgtgaaagaccatttaaagagtggaatatacaatttaatataacagtataatgtaacagggcataataatatttattaaatggatttcagattgcacattgtaatgaagctttaataagtcaccaattgtcaagttttagtgtagtatcaagggagaacgttcacagttatctggaaattatattaaaatattcctctttttccaactgcgtatctatgtgagactgaattttcttcaagtacttcaaaataacatattgcaacagattgtactcacaagtatatatgagaatttagctgactttcgatggccatctattaaagagatgtgcaaaaatgtaaaataccaccactaatctccccaagttttttaagaaaatatatttactttctactaaaatgtgttatttatttaaaaatataatacatgtattattgttttaaattaaattaataagtattttaatttttcaactttttcttttatgagaaatactgataaatataactgacttaaaaaaatctttgggattttcaattaatttcagggtattaagggattcacagacaaaaacattttaaaattgcttttttaatcactgtaatatcatatacagataaagccagtattattcaagtatgtatcacatgcctggtccaatcaaagctctgttaaaatacgctcaattcttttgtttgtaaggaaagtacaataagataaatactattatagcctccttatagataatggaaaaatgagacataattttcccaaatcataagctaatgtgaaaaaagtcaaaatttaaacacaggcagactgtctctcaagtttgtattcttaaacaccattttatattattctgctaagtgttttgttacatgttacagtggtttcaatattttagagtagaacacatgggatatccttgttgaagtgtttggaaaattatttgaagtatttatttggaaggggcttgaaagtatttttctataattaaaaagtgtttgcttatttttaaagctcaaaatagatttgttacctatactattaagtagattttaacatactaaatatcttttattacacattttttagtttctcctaatttacagagtacattatagtggtaagagcaggggctcagactttcttgatttgacattttagggccatggtcaaaccctgtaaactctttgtgcctttgtttcttaatcttgaaaactgagagaaatagaatctatcttgtaaagaacttttgtgagttccttgaactaataaatataaaagtctcagaaacctgcccttaacatagtaaggcttccaataaatactaactatacttgttataataactagatagtattaggtggtcacgaatgtaacctccataaataaagtcttttaagtagaatgataacttgcaccctttgatgtataatttcagttactaatacatgtaaccagacctcatacaattacggttaactgtattttccatcttcaatgcctgataactacatagttggcgtaatcacaactctcaatttgttagctttataaaaatagttgagccaaaatgttaacgtatgcttagcttatcctcactccttttccagtaggattgaggccagtttatttttacctgctatttagagttatagaaaaacctgggttcctagcatcttatctctgatcaattcttgtgatggagtcccttacatttggcaccttgagaagctgctaagttgtccacatcttaatattaggtaccaggctaagtgctttatatacctttttatatttagtcagatagcaaacccataaattcgttatgttatctgactaaatataacctaccttaggtataacataaggtatacctcctagtttccttaggaggaatactgctgtccagaaagtagagtaatatgctcaatgttgcacagctattaggtggcaaatctgagatttaaggccaggcgaatcatctcatcctttgaaagctaactactttgactttcttagcttcaagaaattgaaataattagattgaaattgaaataattagatccatctataagcttatttgcaatattagatcctgtgattctgcaacagttgagacaggagtatggagaataacacagtctttggaatcatataaagtgaagattgaatccttaaccagccatgttagcagtttaaccgagagcaggttcttcaccgagagcaggttcttcaactcttgtgcacatcatttcttcatctaaaaacaaaaataggcataataatttatacctcacaggatagtcaggaggactaaatcaaataatctatacatagcacgtggcatataataagcattcaacatataatatctcacctcctattaactgggactatttttagtttggctccttgggtgctagcccttttccattagaagagagtttgcaaagaagctgttctccaggtttctgaaagctctggttcttgtgttagccccttcatggaagatgtcaaagaattttagataatactatagaaaagtacaatacaaattgatatccattgagaaggcacattttaggagaaaaatgttcccactgaccagaacaaagttctggcacagaggcagagttctgcagccttccacagacacaggcatgtttctttgtccctgtccatggcaaagctatgctctgacctcatcatccttcaatcagttgttcatctaaagcatttcctttctaatgatcatcatcatgaaggtaatttgcttgattggcagcttattatttcctattaccgggtcctctgctaatgagtatttcccatctggataaatatgttttaaatggaacttcttttggaagagtaacaatatctagccttgtttatgcaacaattgtctgtaaaataagaatgccatgaattttatttacttcagaatagcaatagataatattaaaagtattattttgagtaatctccttaaaattggggatattagtagttgtgttgaaacctgtcaaactcagtaaacaagattctcaaaatacttaactcaacttcatttgtaggacattaaccattaaaccattttctatcagattaacttttccgggatagttttgaactgagatgagattgaattgaatacattaactaataagcactagattggacatacagaaaaccaataattagtattgtagtatttgtgttttgggaggtaggataaagtgttatgaggtgtgatgaacaagctttcttaatgagtgagaaaacagctcaaagtacacattgatctataaacaaaattgactgactataaaataaaatgacttgagattataatgctttcataagtcccaaatttggaagggttatacatccaaatacttaaaatatactcattgactgctagggaatataatatttaatagcagattattatactgtcctagttaaaataatcacatgggtaaaactagagatattctattacactcaactcttatctatcttctttaacttcacacttagataggaaatgattgttaacattccttgtatagcacataatttggcctgtccaaagaaagatatggcctttgccctaggcttttgggaggttatttacatcacacataataggaatgtcattgtttaggatgaatttggatctggatttacactggatcttagggtgatgccagccacaccccatagtcttagagtgggagctattcatgccagaaagaccaacaatgtgacttagggtgaggacttttggtcacattgtatcagttggtctggagactgagtccaaacaatgggcaatcaatctattaagtaagcccacataataaagccacaataaaaactatggacatagaaacttgggtgagctttcttagtggtaatctgtgcatattgttactcatcaatgctgggaaggtaatatgtcttgactccactgggagaagacaatggaaatttttatttggaaccttcctagactctttgtagctcttcctttggctgatttcagtttgtgtcctttctccgtaataaacagtaaccataagtacaaaagctttcagagagttgtgtaaatccttctagaaaattattcaacctgagggtgatttggggacccctccctcctgagcttttggttggtgtcagaagtaaggacagttgagggctgtgctctcaaacctcacagtttggttaactccagggattcataataaacattataagcgtcactaaaacctgtattgacttctgaattttctcagcctaaattatattcagtagaattttgctgttattttggacatactgtatttctcagaaagaggtaatcaaacactcgtgtaatacagaatttatcagttgcctactaggcatgtctagctaacatgtaagattattttattagtccagatatttcactgattgagatatgtcataatctcagctatgctctgctttctgattggactaaacaatatatactttttcattaaatgattcaatacaaatatttaagtaaaatattcatattctggtctaaatccatctcagtttttatatggggcaaatcaaataaaagtttgtatttttttctgtctgattttccctaaggttgtcttaatgacctgtgaatagcaagactaattattttgttatgtcctcatcaattgtacaaataaattgaaccagccaaataagctggttccatttgattagctcccactcactctgcttcagccattgtcatttgttgggaagtgagattacagaaaccagctctcccatgaagtggaacactgccaactctgttgggagaacataaatcatatcacagttatatctcaaatccattattaataaaactttgcactgtgggcttcagcctgcagcagacatttatgaacaggtcagaaaatgaagagtgtaaatggaaacactgtgcctttaattacagctgcacaaatggcagcactagagctacagaattgttaaaaatcagttaaggaaggttgccacctgatctgcctgcacataatctgtttaattaggtagtgtgtttctgaaatcaaatgtttctggaaactaagacttttcaacagcatgcaattttccttagaagaaatagttcagatatttactgggctctgctgcttcaaacgaactaagaatttaagaaataattgcactcctttgcacaaatggtataacctgacccaagcttgttaaagaaactcacctggtaccctcttaaaatgtaatataacttttttaagattcattctcaaatcatttgggcattttataatttttattttagttgttcactaatagaaataatattcatgattctgcaatacagaaaatacatctctaattgaaatatgttcataataatttctataatccttaaattataggaaaaaaattagaatttattttctgctttttaataaataatttgacacatgcaatgaagtttgctgtgattcttcagtagaaggactgttagaaacaaaagctgaggaatgctttgtagtagaaagtatcttttggaaaatactctagtaagggaacatttgaaattgtattattggtgtttgtggtacccctatttacaacagttccatcattcactcagttattgttgaattctagcactatttacttattagctcatttattcctcatgtaattatgaggaatttattaatattctcattttatacatgaagaaattgaaactcaaatgattgtggtaacttaagtaagtagatctatgggcatcaaaataaaacattcattaatttcctgagaattttttttatgatgtcactataaataattcttaaagagtagaataaataattaaattaataacaaaggctgggcgcggtagctcacgcctgtaatcccagcacttggggaggctgagatgggcagatcacaaggtcaggagatcgagcccatcctggctaacacggtcaaaccccgtctctactaaaaatacaaaaaattagctgggcatggtggcaggtgcctgtagtcccagctgttcgggaggctgaggcaggagaatcacttgaacctgggaggtggaggttgcagtgagccaagattgcactactgtactccagcctggctgacagagcgagactctgtctcaaaagaaaaaaaataataaataataaaataacaaatgaagacaatgtcaaacttattgtatcttacttctaaatcacaatggcaattgtaatattttaagctaatttaaaaacattttatgcaaaaagatccctattgatgccgttcatcgatctagaaaaaaataaactcttttaacaatacctggtaaacttctaattgtttataaagattaaaaaattgtttataaagattaaaaaatcttgttttttaatatgaaaatgttaaaacacatggaaaacatatagatcctaacatgactcccataaacccattatgtagagttaacaaatgttaatattttgcaaatttgtttctataacctttttgctaaattattttaacataaattacagatatgatacctcaaacttaaatactttttatcaacttaacatttctcccattataatgccaaagagtatcattactatacccaaaaatgttaactaaatttccttaatattgtctaatatcttttgcatttttcagtttcactaattaaccatgaatgtcttttaaagttaatttgtttaaaccaagatccaattaatgaggcattatttttagttggtatgtttctctggtctctttagcttctgcatcacccccaaccttcttttttgtgacattgactagttgaagagaaagttccacctatttgtctaattccttctttggcctcatagtatcatccaatctgtttctctactccctgtattattgataaacaagaagttagatttagcagcttggttaaattcatattatagtattttggaaatgattcttcataagtgattctgtaaacctactgcatttcatctgatggatacaatgtccaattgtcccattattacttttactaagagtgatctgggaattcaggtggctgcagcatgattccttcatggtagatttgtggttttcccttccccgtctgaatcttgctgtgaaaaatgcaattggaggctgtatatttttaattttctgtttcatgccaatctctgtaataccagtaccatattcttatatttcccctggtttaacacataattttgagatttataataggatatatggggagttaaataatccttaattgttgcagaccattttgtctcttgaataaacatctttaaaatgtgaaactgctcttaatatttgtggatctgcgagctggaagttctctcattaaagcaaaaccatcatagaaatccttttctgtaggtttatttttaaaagaacttagtttcctccttctttccaatcccatgaagatcaggatttgcttctggaaaacttacaaagggagacattgatgctttaataaggcaaggggtggttcaatggaaaagcatgtagcaatagctcttgccttagccagatcagttctgttttaatctattacgtgttgaacttctgattctgtgtaacatttggtttaaaaggtagaaaggtataaacagaataataaaagcacacacatatgcgcatgtgtgcgcacgcgcgcgcgcacgcgcgcgcacacacacacacacacacaataacaacacacagtatacaaaatatgccacctcttgtccacctggatcttagtacatggtgtaggagcctgagaatcacctagatggcattgccactggagaagaatctggaaatcctgaccctagctcctcttcagatgagggacaatgggtaaccatgtatgctttgctagtgtaacccacaggcatggtgcataaaatgtttctgttatttttcaaatggaactggctatttcaagctgctgacttttgctcagggtttttttttttctcttgctactgttcttccttgtttttctgccaagaaaaattttcttttttctttatgagacaggatctcacttcctttgagaaaatcttaattatccttcaaaagcagaatacaagtcacctcatctctaaaatcttccctgagcctctcttctgtcttatcacaagaactttccagtttgcaactgattgctggtataattgttttcctccctaaagtgagaggccctcaaagttgggtggcatgtccttttcatccctgttagtcagttcttaggttataataagcaataaatatttgtttaatggataaaaaatattgtaagccttctgtaaaactggaaaagaggaaaaaaaggaaagaaaaggggagaaagagagaaatcatcaacatagaagtctgagatcttatttaaatctctgactttggaatatcaccagctttcagtgcagaaaggcactggtggtcaaagatatgctgacactggcagaacattttgcattaagttgaaaatttaatttatttacttatgacattaacttaataatgccataactcttgatgtccaataaatctgttattgttttaaattttccaataagcattatttgcaatatgatttactggagcacagtcgaatacattttgcatctgtaaaaccacccgcagagtcactggtaggtactagatatgcttattgaactgagtagaaaaaaactatgtgccaaaaaagaatattcatgaaaaaacaattccagtgagaaaccagataatctgtagctttctggaagtttatagagccactacaaaaaggaggaatgaaaagtgggggataagaaacacctcaggacaaatgttatatgttatctcctcagtgccaccagggatgtgctagtcagagtgtgtaagtagacatttatccacacatcgactttagacgcctcaaggcctggcacagtcagatatgacctggagaaaaataacctgggattggagctcaactgctcacacacaatgcttatttcctaaggcccaggaaggaacaggaagaatggaggcccatttcctttttggtataacattcttttcagagggaagatgaaaaacaaaaaaagggtatatgtctatatgtgagactaccatatatatgtgtgtatatatatgtctatatgtgagactatcatatatatgtatatatgtgtgtatatatgtctacatgtgagactaccatatgtgtgtatatatatgttgttgtatatgtatatattagtgtatatatacacataaatatacacatattttatatgtaattatatacacatacatatatataaatgtgtatacacacacacacacacacacactaacaattacttaaggatatacagtaattattgttccagaaactaagaagaaaatagaaaatggcagcaaagaaatggaaaacaatcctttgatttttggcaaactatttttaatttgacatggtatctggaatacttgaagatactctcagtgtaaattagtttattaaatttagcagaattgactatcttttagaaaatataagaaaaatattaatatatatcaatgaagtgaaaaagcaaagcacagaaaactctttagcaaaattctcttcactctgatagtattcagtctcattctgtgagcataacatttttctcaactatgttaatattccatcaaaaaaaatttgttcaagaaaaactgggtttccaatgacttgttaagaaatcaaaatatttcttccttgaataagaggatccgttttttaaaaaatatatttagctttaggagcttaatttgtaaaccatttctttagctactaatttttaagcttaattttaaaactgaattattaaaatataaaataaaaggaaatttttaataaacttggaataatgtctacacaggtttgatcaggagaatcagtggaatagataatattaaatattttcttcaattaaagttatctaaatgtgggggtacagggatggttggggctcatattatcttcacaatgtttgcattccatgaggtgagatggattttaataaaataaattatgataaagtgtgatgagtgcagcagtggggaaatatgcaaaatctaaatgcacttagcatggagaagagaaaaagaaattctaaggacctggctatgcttccttaagtagtgacacctaaactattgcagttgttcttgttgtggttgtttttcagtagttgctttggttcttagttggtttgttttctaatatggatacaagttctttaagctttcatatataggaataatataaaagggaggaggaaccatgttgaaaaaccatgattcacagacatgaatcagcatatagcatttggggaattattactaatttggtatggctagagcaatggtttccaatcagaagtgattttgcccccacagggaaatttggcaatggctggaaacatttttggctttcacaaagggagtggggaacagtactacagcatccaatagggagagaacagggatgctgctataacatcctacggtacaaacaggacatcctccacagcaaataattacctaggccaaaatgtcaataacatcaaggttgagaaatgctgggttagagcatgaaagcttaggtgataaaaagagatgaagctcaacaggcagagtgtccacattatgggggcagaaggaggagctgggatggctttgaatacctgcttcaggaacaaatgagtagcatgagtattatcagtgatgaagaaattaaaggaaagatgcaggcccaaacacaactgcataggtgtgaatggcacagctaaggagtgcattcacagaggttacagtgcacttagtttttcctggagttgtgcagtgagcaaactgcaccatcagtctcagggaagaaacctttttgcagatgtaaaacctgaagaaactgtgaaatctgaaatgattgtaaagtatatttagattgagatgtttcatatgaaaatgcattttcttttttttttttttttttaaaaaacgtgtctagttttagaaattacggacttgattaggagaaaggattaagaagggcatatagattggtaaaaaaatgggaaaaagtttcggggacaagaaagatcaagaattatgtcataaaaatggtgacacaaatagaggaactagtatgggaggtgctgagccatgaggcaggaaagtttaacattgcttgacaaagagatttggatactagttgttggaagtttagatttcatgcagtaggttagaaaaagtccttgtaagttcctgaacaggagagagatggatgaaaatggcctttgagtaatattgtttttccagccgtgtgttagatagatcatagcatgaagaaaatgaggcatgacagggtgatcagctaggagactagtgaagttctgccctcaatttacaaacaaaatagctgctcactgctccccataaaatattcctttatatacatgaaacgtgctattacgtttcctttcaattttcttgggtatgtacacttagtcctttagccttttctcatcaggcacatttcccaacactgcagtgatttattttgctcttgcctttgtactctccaattttatttttccatatctcacttcatttaccatgattcaaattgaacagagtattctaataaagttcagatcaaaactgagtagaaggaaagggtcttatctatttaaaataaaatatttattttttattttttaaggaattgaagattaagaaaaatgaaaagagtgggcttaatccaacattttatatttttaattataaatattgagtaacaagatatgaataactgattagtaaatgtataagctactgtattaaaaggtatttttttatttttatttttttgagacagagtctcactctgttgcctagactggagtgcagtggcatgattttggctcactgcaacctccacctcctcagttcaagtaattcttctgcctcagactcccaagtaactgagatcacaggtgcccgccaccacacctagctaattaaaagttacttcttaaaatttaaatttaaattttattaatttattatttaaatttaaattttcttaaaatttaagcttgtctttagtgtttatagatggacatttccattcaagcctcatttaaatatatgaaaatttaaaaaaataattgcaaggttattttaaaaaaatatttgccttatttaaaaataaggcaaaattattttaaacttatggagttaagttctccctgtattcaggcctagagaaaaaaatttgacctccttctgcctttcattataaatataataaaaatgtaccagcaaaatacctgagtataaatacatgaaaagacttttttccacaagcccaggacggattaaatgattcaaataataggaagaaattctatatcagataatagactagatttatcttcctatttgaaataagtttttcaagttaaaatatgggaaacaataattctcaagacattttacgttaggcaaagagggcaaagatccctgtgaggtaaaaacaaataaggtgagccttctgccatgtgagtgcttcagtttacttcctggataaagtttccaggcacaacatggggagagggaacccaggtagagcctggctcttttttggagttaaggagataaaactggtcatccagggaatacaaggtggctaaagtttgcagaatagagtatcagaggtgagagacacacagacagaaacctgaaaatctgcatacagtctcccgtgattattcagtagagttctgatcagtgcgtgtatatgtgaaaatcatctgagactcgtggaaaaaacacccaaaaggattagcggaaacatctgggaatagtcctatttccatcaatcagagtgaaaaatcttgtaatttacaggggacagttctcagaaatctttgccccagtggggcaaaatttaccctagacaaaatgcctaagaaacttaatagcaagatccaaaaagaccaaactgtttctaagaaatttaaacatactatagagcaaagatcaataatatttatagaaaaaatatttattacccaataacttaaacatttacaatgaatggcattcaaacaagaagtaccaagcatacaaaaaagcaagacaaacaaacaaaaacaacaaaaatcattcaaaactaatccataaatgacacagattatagaattagtaaaactgtattaaaacatttattataactgtattccatatgtttagaaagccagaggaaaggttgaacatgctaaacaatcatgaaagattttttaaaagattcaaatcaggcttccaaagataaaaagtttcagtgtctgagatgaaaaatacactggttgagattaacagaagattaaacattgcagaagaaaatattagagaacttggaaacagcagtagaaaatatctaatgtgaaacataaagcaaaaagcctggaaaagaaaaatgagtagattgttggtgagttgtgaaacaacttcaggtagcctaatatatgtataaatgaagtgcctgaagaaggagtagggcataaaaatatctcaaggaataatagctgaatattttctcaattttataaaagctatacatctgcagatataataacctcaacaacaaacataagaaacataaaaaagcacaccaaagcacattaccatcaaattgcataaaagaagtgataaaatcttaaaagcagccaaaggaaaaaagacacattttgggagagaggaacaaagacaccactgacagcagatttctttggaaacaatgcaagctaaaagacagtggagcaacatctttaaaatatcgaaacaaagaaaccataatctagaattcttcacctaccaaaaataccatttaaaaacagagatgaaataaagatttttttttccagacaaagactaaatgagtgtaacactagcagacctacattataagaaatgttgaaggaattcttaagtagaaacaaaacattaccacatggaaatatggttctacaggaagaaatgaacagcatggatcagtaactatatgagtaaatataaagagttttttttcttattatttaataccctttatagtcaactgtttaaagcaacagcaataacaatgcatcatggaatttataacatatgcagaattgaaatgtgtgaaaacagtgatgcaaaatttggtaagggagaaatggatacatacttggttcttatatgtgaagtgttatagcattgagtaccatgtgatatgaaatacttcagagatgcaagtgtctgctctgaaaaaggaacatctcttgttttccattgatagtttcttcaagtctaattggcatatagtggtggtgaaaagagggcagggagttttgtcatggtagataccatggaagaaatgaagcccaagatgaaaagataagtttttaaaactttgcctcaaagagggaatgcaaaagttaaaaacacaattcagcatctggttgtacttgcagacagggcaaagttgaagcctgacaccccaagagcatccatcatgatgtattatcagaggaccagtctagtggtatttgatccctagcttccaactagtatgtatttcctagttgtaatgttagatatatttcttactatgagtcatggtcagaatagttggtattcgtttgaggatattttactgatgtgttttaagacagcttcagggattttttttacctagactgattaaggccctagaaggctaaatacctttgtgttgctcagatagcctgatttatgagtacccaacaatcacattgtagttctgctgcccaatccttgttacctggccactcccaataagactcagattaaaaatgactgaccccatgaggaaaaggacccattggctgactctccaagacacacagctgacttatgccctcttcatgatggaatccaagaaaacatctgataacaatggctaacatttaatgagtgtttactctgttccattatgatttaagcagtgtacaagacatcaatcttcatataaacatcaaataatcactttgaggacggtgttaacattttatttttgcaggtgagaaacctgaagcactgaagtaactgcaaattcacacatctagtaaatgatggagttttgattcaatgcaggcagcctgactccaaggttatgcactttatcccaataccaaactgcctcttctctaaactgataaaaactgctctcttttcttgctgaaatagaaaagatatagctttttgaggacccatggctaatcatcaaacaatggttttcctctcctccaacccatttctgtaccagaggagtgaccctaccctgcttggagtgaaaagaagctatacccctgcactcttctctagctcaaactaaggaggaatgaaaggcaacattagataggtatttgcacatgtgtgtttttatccatattctgtgaattggtgtctctgttaaaatatccaatcatctggagaaaagataacctgctttagcttcttctggcattaaaaagtcagtctttcatcagtcagacaaacgtattctgggacaagcttaagtagtggccctcacgcactgttagattttctaacagctgaagggtgaataaggaggaacacaattggaagcagagttaacagagttggcagaagaaatatgtaaaggatttatttagttttgtgttgagggttttgtgatgtcaaggctccataaaatcttaactaaaattggcactgctctcctagagttcttggtaaagttagaatgtattccgggaaatgtagagatgccagtttcaaagaagtggtcattgaaagatagctggattatgctaacattgatttttcacattctattccaagatttttttgtgctcagtagtcaatatctctctaaaatgcttaactttaaatatgtgacattatatcacattaaaatgctatatataactcaaatatagaaagttagtccccaaatattgtataaatgtgtatatatattttcactgaactatcaatgtaccaagtttctccaaattttaaatttaaattttggctaaaaatttcaccaatgtataataaccttcataaagctgagtatgcacagaaccatagatattaagatggtatgaccttcttgaaaatagattatgcttacttaattctaacattcagagctttaagcatgcataaggacttaataaatgtgtgtttattggtgctaatgataagattaaaacgtttcgagggctgttaaaattagatttagcacattgtttaaaaaccacaaattccataaagaaaatatttcaagtacatagttaataatatttttactgcgtttttcaactatttttaattctttaactaaatgtgaaaattaacattttaatatcttggtagtggtttccgtatttcttgggtctatcaacataataataatagctaacctttgtttatttttactataagccaggaaaatgtgttagacacttgaacaagttatcttattaaaaccttaaataactcgatgatgaattcaccattttaccttcattttatatgtacaaaacagaagcttaagtcatcgtttggctaatttcacacacacagaaaataagggggagcaaattcaaaccaccaagttttattccagaggctgtgctcttaagtactgcatttttctttctgtactgcatttctttctttctttctttctttcttcctttctttctttctttctttctttctttctttctttctttctttctttctttctttctttctctttcctttcctttcctttcctttcctttcctttcctttcctttccttcctttccttccttccttccttccttccttccttccttccttccttccttccttccttccttccctttattccttccctttcttcgctttttttttatgctttcagtttttgggtacatgtgcacaacgtgcaggttagttacatgtgtatacatgtgccatgttggtgtgctgcacccattaactcatcatttaacattaggtatatctcctaatactatccctcccccctcccccgaccccacaacaggccccagtgtgtgatgttccccttcctgtgtccatgtgttctcagtgttcaattcccacctatgagtgagaacacgtggtgtttggttttttgtccttgagatagtttgttgagaatgatggtttccagcttcatccatgtccctacaaaggacatgaactcatcattttttatggctgcatagtattccatggtgtatatgtgccacattttcttaatccagtctatcatggttggacatttgggttggttccaagtctttgctattgtgaatagtgccacaataaacatacctgtgcatgtgtcttatagcagcatgatttataatcctttgggtatatacccagtaatggcattgctgggtcaaatggtatttctagttctagatccctgagaaatcaccacactgacttccacaatggttgaactagtttacagtctcaccaacattgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccacttgttgatggggttgtttgtttttttcttgtaaatttgtttgagttcatcgtagattctggatattagccctttgtcagatgagtagattgcaaaaattttctcccattctgtaggttgcctgttcactctgatggtagtttcttttgctgtgcagaagttctttagtttaattagatcgcatttgtcaattttggcttttgttgccattgcttttggtgttttggacatgaagtccttgcccatgcctatgtcctgaatggtattgcctaggttttcttctagggtttgtatggttttaggtctaacatttaagtctttaatccatcttgaattaatttttgtataaggtgcaaggaagggatccagtttcagctttctgcatatggctagccagttttcccagcaccatttattaaatagggaatcctttccccattgcttgtttttgtcaggtttgtcaaagatcagatagttgtagatatgtggcattatttctgagggctctattctgttccattgatctatatctctgttttggtaccagtaccatgctgttttggttactgtagccttgtagtatagtttgaaatcaggtagcatgatgcctccagctttgttcttttggcttaggattgacttggcgatgcgggctcttttttcattccatatgaactttaaagtagttttttccaattctgtgaagaaagtcattggtagcttgatgggggatggcaatgaatctgtaaattaccttgggcagcatggccattttcacgatattgattcttcctacccacgagcatggaatgttcttccatttgtttgtatcctcttttatttccttgagcagtggtttgtagttctccttgaagaggtccttcacatcccttgtaagttgtattcataggtattttattctctttgaagcaactgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatacacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctagtttattgagagtttttagtatgaagggctgttgaattttgtcaaaggccttttctgcatctattgagataatcgtatgttttttgtcgttggttctgtttatatgctggattacgtttattgatttgtgtatgttgaaccagccttgcatcccagggatgaagcccacttgatcatggtggataagctttttgatgtgctgctggattcggttcgccagtattttattgaggatttttgcatccatgttcatcagggattttgaaaccaacgagaacaaagacacaacataccagaatctctgggacacattcaaagcagtgcgtggagggaaatttatggcactaaatgcccacaagagaaagcaggaaagatctaaaattgacaccctaacatcacaattaaaagaactagagaagcaagagcaaacacattcaaaagctagcagaaggcaagaaataactaagatcagagcagaactgacagaaatagagacacaaaaaaaccctccaaaaaatcaatgaatccaggagctggttttttgaaaagctcaacgaaattgatagaccactaggaagactaataaagaagaaaagagagaagaatcaaatagatgcaataaaaaatgataaaggggatatcaccaccgatcccacagaaatacaaactaccatcagagaatactatcaacaactctacacaaaaaaactagaaaatctagaagaaatggataaattcctggacacctacaccctcccaagagtaaaccaggaagacattgaatctgtgaatagaccaataacaggctctgaaattgaggcaataattaatagcttaccaaccaaaaaaagtccaggaccagatggattcacagcctcattctaccagaggtacaaggaggagctggtaccataactgctgaaagtattccaatcaatagaaaaagagggaatcctccttcattttatgaggccagcataatcctgataccaaattctttcttccctttctttctcctttcctttcttttctttttttttttttttttttttttttttttgtcactgctgcccagactggagggcagtggcacacaatctcggctcactgcaacctccacctcccaggatcaagcgatttcatgcgtcagcctcctgaatagttgggattacaggcttgtgccatcatgcccagctaatttttgtagttttagtagagacagggttttgccatgttggctatgctggtctccaactcctgacctcaggtgatctgcccacctcagcctcccaaagtgctgggattacaggtgagagccacggcacctggcctgcatttctttacctataattatctatctctcttgacctctaatgtcactaattcataaatagcaaaaaagtctaaatacttctcctcaaattaggctaacctctgagtttttcttgctgggtattactttcctagtttcctttcttcaaggtactttcaccaacataaagcctcttgtagcaattagttaaatttgataaattttatcacttattggaaggatagaaagtaactttagcaacaaaaatatgaaaataagcatgaatattacttgaagtcaaagggtagttagagatggggtgatgattctttgtttaaaattaaagccattactttttatacagttggtgattatcagagagggacagagagaatggggcatgcaatagaatttgatgaatattttatagttggtgaaaatagaaaagcagttactaaacactgccagatgatgtgctgctgtaggatccctgaagtggtagagcagaatgaacatactggggtactttgaggccaagtacagacatgattaaaaaatctcgttaacagaaaggccataatgaattatatttatagtaatattgagataataataatatcatttgaaagacttttggagacattttagcgtggataaacatagttattttccagaataatgattttgaaaataactgttagcattatgtatttgagaaaacacagcggcaacaactgtgaacttgatgccaatattttctgactttttgtttttctggttctatagctataaggtaggcatattttcaacagtaattttaggaaataaaacagcttgagatggaagattattaatgaggaggcttatgaacattccctgaatgtttaggaatggatatataaatgaacaccattatgaacgcattaaatattaatattgatatttaagtatatattttacttatcattggacctctgtctaatgagcatataggttttattgggtttattttcaggcaacgctcttcaccaatcaaatgaataagaatgaggaatttttgcttactttaggagctatgggtgtgcgtgcatgtgtgtgtttgtgtgtgtgtgctgtttctgtatgggtaatatttaggtgtagtgttttgtctatatttatctaaaaacttatgacttaatgacaactcatcagatacaactaatgagtttagcagaaaaattggattaggccattttttcatctgttttacaaaaactgatataagccagtttaataaaagggcacaagcttttctctaaatggtaattttataagacatttaaaaataataattcaatctacttttatgtgggtcatgatttatgtgagttatgtgaatcatgattcagcaaaattttatttggggaataagaatatactattctctttaattctctctttcattagtttgaataacaacttagcaccataatttacagacataatgttttctagttttgatctgacaacttaaatctaacaattaataagataatttataaataatcaggcccattaggacagaaatgctttccatagcaattatgtgcagctaaatgtttcctcaaggaaacatttgactctatgtccatgtgcatgcatatggaaatatagtgttatttagatataaactaatatctattgtttaagctaatattatataatagatatctgagtattcagaaacaacttaaaaatgtgcttttagtcaaaaggataattcctgaaatttattaccttcatttaaaaaatataaatttccttatgtacttcaaaaagaataaagttatggagctgtgtaaatttctctattgagaaaaatcaatattttataaatatttttaaattatagaaaaagtaaggttaatatttgatgttttatacctaaactttcaaaaatataatgttctcttgcgtctgttttcttttaaaatctggttacactgacttcagatataattaagaactctgctttgttatatttggaaaatcaaaacataccagatttgagctgatagaaaaagaaaatgctcttgctcagagtattacaatataaaatattgtagagggcaatagtatattcaaaacctttttctttgaagaaataaaaaatgggtaaagacttgtgtttgcagtttgtatgtgtatcatttagcagatttaatattttaatttttcagttgtttgcttgacattggagtatattttatccttcctttaaattgttacaggtgacatatttatttttgatacaataagtgaattaaaatgggatttatttgcatatttttatgtatgccctggtgggtagcaaaattatgcttggaaatttctggcttcagtaagttttttagtcttcatattcacaaataaataatctctttaattggatcaaagcaacttacccaaggttcatgtgaattctttatcagcaggattattgtattatgagaatctgagtttcatatttacagtcctgtgtctgagataattggattgttttggtaaagaattgtgctaacaaaaggaaaatgaggcagaggaagaaaagaaggaacttgatacatacaaatagacacgaatacaagaaaaaagttaggcactacattaaccaatgtgagatataaaggaatatgaataattaatttgtttaaagcagtgtacctccagaaaaaattttggtctgtatttggcatcgtcaaatgccatttaataaaatagcaccagaatattgattaagtagtgttgctttgaatggtacagttttatgctttttattccctgggcaaagtaagttattattcctggaagaaataaagttgggcaaagtctattacagaatcacactagtcaattatgctaaatttctgcccaggatgctgactgccttggtttaaactgttagtctttacctcatctacagtttcttttccttcaatagatatatattaatctactagagtgttccagatatatttttaagtgctagagaacataaagatgaatgagacacggtccttgtcgttatgaggatcccagtctactaaatgagaagtattgtaattttttaaatgggcttataacattaatggctaccattttaagcactagtcatgtattaggcattattaaatgttttcaccaactcccttaacatttccatggaattaaagaaaaagatgaagccaggaggcttctgaaactagccagcaacacacaggaaggaaacaaccttgccagcagagctgctgaggaaagaccttaagacatgttctggaaggatccagtggctggaactggaatagtacaaataccagttaatatctaactgataaaataaggcatttaatatagggtgcttaagatttcatactttatcctcagcagaaatgggaaactactacatatttttgtatggattttattgatctctcagcgatatctgtcacattttctactgtggttcctaaaacctttgatacccagtgtctccagtacagtgtcactgtaataacatatcttctatcgtaggtctgcacttactctttacagtttcagtgtacaatttacagtttcagtgtactttcaaaataagtatcttaaagaataagatatcttattcttacaggaatctgagatatgtagcacatactttaactattttggagaagggagaaatgctgagtgttccagcagctatcataataacccttgcatatttttcagtagcataagattagaattatgggaacaagaaggagatgcagccatgtgggatggaggagaagcaagagaagtgaatgctgtgttggggctggggggacccaatgctaaggacaactgacaatcacttcaacatctcccatctgccaacctcactagcaacatcacttctatagtaaactaccatctggcatggctaagaaatgagatgttttactaaataacgtactcagtttaatagaacttttgggttgaattatgtgctttcaaataagtagactaaaggacatgtagtataaaattatgcagcccatattttaaactttctttgaacatctaaaactacttcaggcctactcagtcccttggatcttcataaatttgggggaaaaaaccctcatactttcaaggcaccatgtctgacactgggaatgcaaagatgaaatcctatagcccctacccttaaggagctcgccatttagccaatcgtgcaataattacattgattatagagcatctgagtatttatgtcaaggtacatgaccagcctaggaataatgatggaggtatacaggaagacagaatggaaaattaaacccaagcaacatggaaaacaatgttatgagctgtagctaatactatagatacaacaaaattgaaagtaatagaatgttctagttgaaaatttattccacgggtcctaaagtcacccctttgtagattacttgtaacattacttgtatttttatgaaatacgtgatcactatgtaatttttgcatggtattgactaagacaagagagtaatttcccagtcagaaaatgttattgttgcatactgggctaacccaccctcttgtagtttgtaggtgccaactatgaacccaggttttgttgttttgattcatcgatgtttacgctgtcatttttttttagcttttcctgcttcacactaattatactattcactatcctgcactctgcttttcactttgcttccactcctgtctcacgctgagaaaccatttcacacctgtatcaatgcagtgctctctattcgtcatcccacatctcactgcagttaaagtaaaatttttgaatgataagcctaatcatgtcacttcccctcataatatctattagtggccatgatgataaaagcctataacatgtctacaaggccctgcagtggtctaatccacgcctctccttctagcttcatcttgtactactgtctccgtgctcactatgctacagcaacacttgcctgttttcaaatcctggaatacatcctatggcatcttgtctcatagcttttcacatgctgttctctctccctacaatgctctgatacccctgcccccgaaccctacctcggcttccttaatacttatttatcctgatgtcagtccaaatgacccttcctctacaaacatttttcttgtcctccagaaaaagctggttgtctttgttggtgtgccatgcccattcatagcttgaatatcaatctgtttttgccattttaatataattatattcactcattgaacaggtatttattgaacatttactatgttccagacactggagttacatggtcttatgtccatgtccatgttacatgtaactggagttacaaaagacaaagaagccctattttttttaacgaagtttatagtttaatggttgaaaaaaatgaaatgaataatactttaaaaactgaatttcacacatagtttctgtagatgaaataaaacaaggtgatttggtaaaaagcacaaagcagagagggacaagtgggttatttagagtggatatcaagtaaggctttctaaggaagtgacatttggactgtgattttattgctaagagaatgccaatcacaggagggccaggtggcagaactttcaaggaaagggaaaggccagtgaaaatgtctgtctggaggcagaaacaagcatggcagttggaagaagaagaccagtgtggcagatttaattaaaattggccgtcacgtgcctgtctcctccactagactgcaagtgtctgtagggtggggctctgtctcctttatgtctgaagtttattgtacaaaatcacactttaaaactctgctcagcagttaattcttttgggaagaatttgatgtcttctctcctgctctctgcccatccccaccacagaaacacacacctgcattcatcctgggtagaaatgactgctttctttttgtaattcaatgctactgccttcatatattttttcttaacatgtggaacattttctcgtatttgtttgtttttatacctctcacttctaacaatgtcttgagagtagggactatttctgattcagttacatgtttcaaatgcctagtgtaataagctcttaagcatgcaatcaaattttgttgcaatgaatgagacaacgaatatatactgccttatctctgctatggcttctatttttgtcttggtcaaggtttcttggaaaacagaacctgaggttaggtaccttaaatggtaatgtggttattgagatgtacaatctcagggccaggcaaatggaagtgatgccaggcaggatgagaatgagatgatgttacacaactggctctcaactagttgcttggccatatgagatgtctccagataggctgtttggaaaatccacccctagaggagtattcaccagaggcatgatagagagggaatttatctgctgacttcctcttgcctctagttttctattatttatcaatgtattgatgttaactcccctgggtcaactggccccacgggtaccctatggagaagtaagatctcttgcctgtacttcatctgggaccgaaagcaatgggaagaactggagattcagtgttggtctcaggcagttggtcaacaggggcccacagggtcagttgtggcagtggcagctatggtggaacaaatggccaaggacatgagattgcaggcaaatttgagctgctctgagaaagtgcataagaagtgactaataaaatctgcaaacttgattttcttctaagctctttcttctccacccataaaaatatttaacttggccggacacagtggctcatgcctgtaatcccagcactttgggaggccaaggcaggtggatcacctgaggtcaggagttcaaggccacccagactaacatagagaaaccccgtctctactaaaaatacaaaattagacaggcgtggtgacccatgcctgtaatcccagctacttgggaggctgaggcagaagaatcacttgaacccaggaggcgaaggttgtggtgagtcgagatggcaccattgcactccagcctgagcaacaagagcaagacttcgtatcaaaaaaaaaaaaaaaaaaatagaccagttacggtggcttacacccattatctcagcactttgggaggctgaggcaggaggatcacttgggcctaggagttctagatcagcctgggcaacatagggaaaccttgtctctacagaaagtaaaaaaattagctgggcatggtggtatgcacctgtggtcccagctactcctgaggctgaggtgggagaaatgcttgagcccaagaggtcaaagctgtagtgagctatgattgcaccactgtactccatcctgggtgacagagcaagaccctgtttcttcaaaatattaaataaatacatacataaatgcatatataaaatgaaaacaagaaacaaacttctgtgaccccaaattcccttttaatttcctcttagttccctctctcctttctaccaaaacttttgttccatgtgtctatgcctcacccttgacacaccatggagggccagccccctttagggttttacatctgctgtgctcttatatggctcccatctctttggtcttgctgtcatctgcgcctagagtgatcttttctacttttttatgtctttgtaactcggaccaaatgtcatctatgccacttgctgacccttttcccagcttagtctgaatgtcacgcccctccttacttaaaatggcatcctgcccttccctgaatcataatacttatcacattggtttaatatggtatgttttatacatccttccaaaaatattgtgagaccgaattctctcacttttagattcatctttgtgtattgatttttggttcaatgtcttgtccacagtaagtagtaaatacatgttagctaagcaaaactatactagttaagactaatagaataggcgactgaccagaagatcttatttaattttaacctggaaaaaaaggccagaaaataatacataaaatttcaccttataattaataaactcttgatttaattgtgatttaaaattatattatgaaaatatgttaaagtgatgattatctgtgatagagtcttcaagatggccatgatcaattatttcctttcctttgtgactttgtttcttttccatcaagaggttgtgtttattcccttccccttaatttcagaattcaggctgggtttataacttgtcttggttaacagaatgtgaaagaaatacctgaaaggaggtgaaaagcttccactttctcttttgaggcattcagctgcaatatgagtagtgtatcttcccaatatcaccatgtggtattgtgagaatgactaatctagtcgtgtgaagagaaagaggtcacattaaaaaacaaacaaaacaaaacaaaacaaacaaacaaaaaccctgacttgtgacctgacatgaagctttttgaacttttccgcccaggtctgcagccaagtaaaatgcacccaaatgagtaatcccagccagtgccacctggaacagaacaacctctcagctcagctcatctaacctacagaaccatgaaaaaataatagatcattgttctaatctacaaggtttagggtgatttgttgaatattgatagataatggaaatacccatatttagcttggcatttcctttaaaaatgagtcttaactttatgacttagtaccaaaatggttggcttctgataatgaccctagaattgattacagtcaagcctgatcattcagtttacaagagtccaccaagtgtttctgtgaaagtagaacattatagaatgcattataagatgggcacaacagaattgtgtgcattgctttgtggccatatgcacacagtagactcttattagtggaatgatgagtacataagaaacatgagaaaaataatagctggtggggaagactctaagtaaaggaaaacccttgacatcattaggagtaaacttgctgtattagggttctccagagagacagaccaataggagatatatatatatgagagaggcgatttttttagggaaattggcttacagtattatggagactgagaagtctcatgatagacaataggctgtctgcaagctggagaaccagggaagccagttgccttactgtccaaggctgaaagccttagaaacagggaagcctgtggtgtaactccatttgtggatgaaagccacagagtccaaagaccagagaacctggagttttaatatccaggggcaggagaaaaagggtgtcccagatccaagaaagagtaaacaaatttgccttttctctgcgtctttgttcatctgcatgcttcactaattgaatggtgcacacccacattaaggggggattttcctcactaagtgtacagactcacatgccaatctcctagggaaatactctcaaagacacatctagaaatcatgttgtaccagttttcttggtatcccctaatccagtcaagttgacaccttgcttacttgcaatcatgcaactttctaacaatatgttgaaaataatgttagtaataacaataacaataaaaaagcacattttattgagttcttatatatgtctagaaaatagtatctcatttaatactcagaataaccatatgagacagttgctataattatagctacttcacagttaattaaactgaaatatagagaaattgagtaacttgtaccaagccacatgacaagtggtagagtctggctgaaagcagattgtctgatactagacccctcaattgttaactgctggttatactaatatataatgtctgttagcataatcacctattatatatatgtatataaatgtgcaatattcataattctactgtgtgtgtgtgtgagtgtgtgtgtgtgtgtgtgtgtgtgtgtgtgtgtgtgtattatgcttttctttaagcaacaaatgctgccatgacaagatgttttggaataccaaggtcctctatatttcaatgtcgaaggtagtacatagctttggtaaatgacttccctttactgatagcctgactgtacctactttccccttccttctatcccttatttggatgttgtaactggaattaccttctccagtcctccttgctgctcattgaacagctcatgaaccaactgggctatgtatatccattattaaagaacaagaacctgatgttaggacagaataaaggtatttgagtataatatgtaatctattattttctcattacttctacctcaactgttattccttagttctccaaataggagaaaataatttttacctcttttgaaatcacaagcggggttgtagaagtgattttaaacattcaggcacatactcccatacacacataacaaaccctattccacccatcagcttaatgttcttggcaatttatttaactcacactgtgggcaaccactgccagcttcaattggcttgctgcctttattgatgttttcaggacccaagacctttttattcatgtttcccattaatctcagatgctttacaacatttctaaagacaggaaaacatattgggtcaaatttacagctatctttgaactcagtagttgaatctgctaagtcaaacccaggtttcagccagcaaagtagctttgaaatgctagtttgaaaaagactcaaaaagctttcttaggtgtcagttcctcctgggagaaaagagacaggaatcgcattttaatgattcaagtctaggtatatcacaagtgcagcctgtttattttatttttagtggagtgagaagaatcacctattgaagatgctttcttatatccacatatttattttatttttagtggagtgagaagaatcacctattgaagaatctttcttaaattcacatatttagtctgtttttttaaaaagtttaaacccatcacacactacagaggcaagatatttttataaatcacatgctttcatcttacatgatatcttagtaatacagtaattctttaatataaggcttacaaatattttaaaaaacttttcagcataattcttttgagaatagggctagtattggtcacaactataaaacatggcatttatttttggttccctgtcatctttcttccagtcctttgtattacccaccaggtatacctaccttggggcccatctatcagtgcttcagctctcagcaataacctattacttttaaaataaagggtgttttctctgggcaaaattaagaagttagtcagccctcctttgatctttatgacacttttcaacatttcccacccctgcttactttctcttccttcaggtgttagaaaatctttttaaaatatcccctctcactccatcagataggggaattaacagcaatatttattattttattacctaatcataagctaaaacaaatatcttttaaccaaatatatatcaaaatttgtactttaagttcaatttctgagttttaatggtggcaatgttaggtttcagcctcctttaaatatacttttgagtatgagaatatgtgtgggggtatgtctcaaagataaggaacccctggagttgcatgtttaatccaaaggtagacttgcaagtattactgacttcagaatgaagcagtgtagtggggaagggaaaatctcctaatgccttcccaaggaggacaagcaagtgcaggtccagccaaggcttcttacctaggtttcccttgcatttggaagatgtatcagccagaggtcagctgcagataaattagtaaaaccagcctagcaattttaagaagaaatggcttaaatatagggaaatatacaattataaaatagttggaagtactgaaggacaggctctgggatggcctctgtaattctaccacagaccaggccctccagggatgctgccaactgtcaccattagaaaggtgggtgattgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaggtgggtgattggaaaacagccacttcccggttgtcttagatgaaattccaagatcaggaaactgctgcactatttcattagaactgcatcagctgacattgaattcctagaagccatggcttccctctcaatctcaattcacattcaaataaatgatttttctttaatgacaaatgactgtcagaacctaagtcactttcagaggtgtagctgcaagggagtcttgaaaatgcagatttttagctgtctgggccttatagtacagaaaaaggtgagaaaagatgccaaaaggagtcaatcctgacatattttttaaaaatgcaagtgcttgagtcatttttatgacccctgatcaaaacagttacacattgcaaaaaaaggcattgcctagataaacaaaatattcttgaatcatttgctctaaactaggatattatttctaggcctttactctatttacttggaacactttttctgtctgtattattgatgatggcaattagatatgaatatctaatatgtttgtcataaggaaagatattaattgtgttaataagattcagtaatgatataatttaatgccatttgtttctcatagttaagttctagatttcaaaaaatttttctattaaaagattgataattctcaattctgcaaggaagggagaacaacataaactgattttttattaaacccgagaaccatttaggaataaatgattgatatgttgaattgtctcctgcaaataggtgaagatacctgaaaaataaaacatggtatctttcattcttactgaggtgattaaatgagaacaagtatggctatctgaattatccctgtgaactttaataagctactctatctattagggaatctgaactgaagactatgcaggcatacaaaggctcctaagttcagtacaattaagggggaagaagagggaacacattattattataataaaaaagtaaaagtgcaatttaccccagtaaaaaaaaaggcactacaaaaacctgaaaatagtagaggaaaagtgcttttaaaatttttcaattatcaataacaattgaaagataatataaaattcattaattatatagctgaaaatatatactaataagagaataattacactatactttagtggaactgagcaaaatgtaaatattataaagaaacaaacataaaatatatatttaaacttcagtacacaatatgatgctattgtagcatttttccatttgtcgaaggcaatgataaaagtgaaaactgggctgggtgctgtggctcacacctgtaatcccagcactttggaaggccaaggctggcagatcacctgaggtcaggagttcgagaccagcctgaccaacatggagaaactccatctcaactataaaaaaatacaaaagttagccgggcgtggtggtgcatgcctgtaatcccagctactacggaggctgaggcaggagaattgcttcaacccgggaagtggaggttgtggtaagccaagattgcgccattacactccagcctgggcaacaagggtgaaactctgtctcaaaaaaaaagtgaaaactgaagtgaaagtagtaatatgtaggaaattttatgattttccaaatgtgtataatggattttcatggtgaactgtgttttgtattcaaacacaagaatttttaaaactcagacaaaaatggattaattcttaagtgtctcaggggaacttaactggaaattttgtgtatcttatttattgaaatgctataaaataggcaaacacatttaattgggattcaggcggtttaagcacagttcagtattacacagataaataatggacctgtacaaaattgaactggtgctttaaaatccacgatcatgcctgtaatctgaacaccttgggaggccaaggcaggaaaatggctttaacctagcagtttgaggctgcagtgagctatgattgcgccacttcactccagcctgagtgacagagcaagaacctctccctaaaagaaaaaaataaaatccatgatatttcttttttttctttatgttttattttatttattattattatactttaagttttagggtacgtgtgcacaatgtgcaggttagttacatatgtatacatgtgccatgctggtgcactgcacccattaactcgtcatctagcattaggtatatctcccaatgccatccctcccccctgcccccaccccacaacagtacccagagtgtgatgttccccttcctgtgtccatgtgttctcattgttcaattcccacctatgagtgagaatatgtggcgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcattgtggttttgatttgcatttctctgatggccattgatggtgagcattttttcatgtgttttttggctggataaatgtcttattttgagaagtgtctgttcatgtcctttgcacactttttgatggggttgtttgatttttcttgtaaatttgtttgagttcattgtagattcttgatattagccctttgtcagatgagtaggttgtgaaaatgttctcccattctgtaggttgcctgttcactctgatggtagtttcttttgctgtgcagaagctctttagtttaattagatcccatttgtcaattttggcttttgttgccattccttttggtgttttagacatgaagtccttgcccatgcctatgtcctgaatggtaatgcctaggttttcttctagggtttttatggttttaggttgaatgtttaagtctttaatccatcttgaattgatttttatacaaggtgtaaggaagggatccagtttcagctttctacatatggcgagccagttctcccagcaccatttattaaatatggaatcccttttgcattgcttgtttttctcaggtttgtcaaagatcagatagtcatagatatgcggcattatttctgagggctctgttctgttccattgatctatatctttgttttggtaccagtaccacactgttttggttactgtagccttgtagtatagtttgaagtcaggtagcatgatgcctccagctttgtccttttggcttaggattgacttggcaatgcgggctcttttttggttccatatgaactttaaagtagttttttccagttctgggaagaaagtctttggtagtttgatggggatggcattgaatctgtaaattaccttgggcagtatggccattttcatgatgttgattcttcctacccatgagcatggaatgttcttccatttgtttgtatcctcttttatttccttgagcagtggtttgtagttctccttaaagaggtccttcacatcccttgtaagttggattcctaggtattttattctctttgaagcaattgtgaatgggagttcactcatgatttggctttctgtttgtctgttgttggtgtataagaatgcttttgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgaatattagacacatcaacgagacagaaagtcaacaaggatacccaggaattgaactcagctctgcaccaagcggacctaatagacatctacagaactccccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactgaggattaagaatctcactcaaaaccgctcaactacatggaaactgaacaacctgctcctgaatgactactgggtacataacgaaatgaaggcagaaataaagatgttctttgaaaccaatgagaacaaagacaccacataccagaatctctgggacacattcaaagcagtgtgtagagggaaatttatagcactaaatgcccacaagagaaagcaggaaacatccaaaattgacaccctaatatcacaattaaaagaactagaaaagcaagagcaaacacattcaaaagctagctgaaggcaagaaataactaaaatcagagcagaactgaaggaaatagagacacaaaaaacccttcaaaaaattcatgaatccaggagctggttttttgaaaggatcaacaaaattgataaactgctagcaagactaataaagaaaaaaagagagaagaatcaaatagacgcaataaaaaatcataaaggagatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccatctgaaactattccaatcaatagaaaaagagggaatcctcgctaactcattttatgaggccagcatcgtcctgatactaaagctgggcagagacacaaccaaaaaagagaattttagaccaatatccttgatgaacattgatgcaaaaatcctaaataaaatactggcaaaccaaatccagcagcacatcaaaaagcttatccactgtgagcaagtgggcttcatccctgggatgcaaggctggttcaatatatgcaaatcaataaatgtaatccagcatataaacagaaccaaagacaaatccatgatatttctatcatgcttcttgtactctcttctcggaggaattgctttgcattttggctaatgaaatcatgtcccctctttactttctctcaagtctatctcttttactgctttcccagacagatcagttttagcttaccatagcaacctctgggacttgacccagtctttgcagacctgtcagatcagtgttctctcttgagcaaattccttaagtgactctttcctatcacattagatctaacttgctctttttgaattctctaatagggatatgtttaaattagttgaattaatttttgctgctctttctgaatgcacttctgtgagtctaatgagtctaggcttctttaatttaaataaaactataatgcttattccagcatctatacctttatttacaattatccctttgatcaaaatatctgtctgtcatttattcagttaccaaatcctcaacacttctggagatcctaggccaaacttttcttatctatcaatgagttctctgaccactaggtctattttaatccacccgctccctcacttctttactctcttgttgcatttagaataattctgtcttatattgtttgctgttaagttcatgtgttttaatcaattgtcctgcaaaaagctgtaaactccttgaaaacatgggctgtgctttcatcttcttaattaaaagcaataactagctcataggtcactttccaggagttttcaatattatgctttagctctaataaaatctttataagagaatataaatgacctagaaatgttaataaaatatacaccacttaaaaagtatgttgattaaagtgaaattttagaaatatgaattaaaaataagtaataaagacaaacatcacaatgagctttaccttaaaaacatcatctgaggtagtacaggaaattatacagagaatatttgaaaaaaaaaatatatatatatatatataatatatatatatatatatatatattttttttttttttttttttttttttttgaggcagagtctccctctgtcacccaggctggagtgcagtggcacgatctcagctcactgaaacctccacctcccaggttcaagtgattctcatgcctcagcctcctgagtagctgggattacaggtgtgtgccactagggaaaatagaattttaaaaagcaaaatgactaatcaagtctgtgtagatactgactgataagtagaaagtagaacatttctcactctctctcagcattagaaccctgagatcaacattagccaagtcatgaatttgtaggtatatgtagaattagaaagaagcaatttggaaacaactgttaaataattgattgatttatattaaaagagatgaaatctgtaatacatatctatctgaaggtattataatttgaattccagtccctcttattttaggggttaaatggatattaagggagtgtgaaccagtggttaaaatctctttgggacttagaagtatctgagataaaatcctgtctcttctattaattaaggtgtgattgtggcctagttacttagcttccccacccagtttcagtctttataaaataagcataataatagtgtctacctcatagagtgagtagaagattaaatgtgatacagaatttatagcggggaaaaattcttggcatatgaaagtattaaatacatgtttgctgttattgctattattattttcataaaatatattatcttttacattcactcagaaccagagccaatatttctataaactgtattgttttggaattaaatgaaaagttgtgtgataatatgttactcgtttcaatacataaggaatttatacttcttccttacaaaaatagaggttttgagaatattcctcattatttcagaggtgaaacaacagaatatgacagaaaatactgaaaaatactattgtaaaaaagatgcggttaaatcatcattggccattgcaagtaaaattttgggattaagtatactgttaaattagtcaatatgtacattttaactgaaataaataattagcttagataatacttctaacttaagataactcattattctcatttgaacttaaaattcttccactggtggtaatttgaaatgggctataatcccattggtaccttttttatgacaagggttttggatcctcctgtcagaattcaactcagatttaaaaccagactctggtctcactttctccattagataacaccaaagattgccctatttccctttagaatttattatttatatcacattttaaaaaatttggtaatttgaggccttgtcttgcaacttactacctcatggatatatgtcttaacaactcaattttaattttatagaggatagattactcagtattctcatctgtaaaacagatataataagggtgtctgcctgatgagaatggtataggaatcaagagtaaacataagtaaaatgcttagaagagtgtctggcatatattcaaacctatttgttaaataaaaactagatttcttttgcatttttttaatcacctatactatgctatttttgacaatgaaaacaaaattgtacttgaaataatcatgaagaaattggccatttgggataataatgtacttttatgctgaaggctgcttttaactaatacaaatgcatccaatatagataaattagtaaaatcttaatgagataaataaatcagtttgcctttgtaaaactttaaatgtatctaaatttagtgacttaatttagtgacttttccaattaatttgttgtctacaccatcttctaaatatactacttaaattcctgttcccatgtcttaacttttgcagttatgcccaaataccttatgcttccgctcctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggaggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgcatagaagagtttaccagggtcagtaaattccaactcacattaagaacattaggagaggtttaaaaatctttctggaccgcaccctgtggaaattcaatttttaaagcttcccgagttaagtctaaagtgtaggtagagttaaaagccacttgaaggcaggcatggtggctcatgcctgtcatgccagcactttgagaggctgaggcaggcggattgcttgagctcagaagttagagaccagcctgggaaacatggtgaaaccccgtttctccaaaaaatacaaaaattagtcgggtgtagtggcagacacctgtattccgagctatgcaggagactgaggcaggagaattgcttgagcccaggaggtggagattgcagtgagccaagatcgtgccactgcactctagcctctaccctgggctacacagcgagactgtcttaaaaaagaaaaaaaaaaaccacttatctggggagaggagtaattaacgaataaaagttgttctgtgacagtcttatggaattagttcccagagcaactgatatgaaagataatttggaacttcagaaaatatggtgttttgctagcagagtcaagggaaaatttgctataaagaggctgagttgtgcagtttgtaatctgaattgtacagaatctgcagttcataatcagtttcagcttttgctgagaatttgaagaatgccataaaaatatttactggatttaacaaaatggagttcattggttttggcaaagcagatgacaagttgaaaacagattacagtagaaatagtttattctatatagattatctaatttctattttttcccaaaaacaccgtggttataatcttttgtctaacatctgttggattgtcattttcttactgatacataacaatgtcttgtaatttaaacattactgaatttattacatattttaaagtctttataaaaattgctttgttgtcttaattttatttttaatttaatgttcttttggttttgtcatttcaaagtttaaaatattatgcagtagaatttaccaatctgatacagtaaactaagggaagacactgggcaggagcaatttatacacaatgagacaaaccaaggaagaaaattttaattaaatttttcttatgtgtaattgaggatattgattaaaaattgatgactttccattttcaatatggtgattattaattttgcttcttttgtcttcctttcatgtatgaatatttgtactgttctaacatctattaccttaatttaatggctagtgaacattattttaatggaaaattctttaaacgttaaggcatttagtgaggtagataatagaagcaaataaacactatttaagatttatattattatctaaccattgcacaaaaggcatctcataactctaactcatagtaaaatgagtatattgatctctccatttcccaaatagtgttttaaagataaaatgaataatatgtcttcatcattattaaattattgtggagatatttaaaattatgatagaaggtttaggattcttaatggactataggttatttataaaaataaatgaatggattgcatttagaaagaatatttataaagctaattttcatacaactttattttgccatccaaataatattttttggacaattgaaacctagatctctgaaaaagaatttcagtctgtactcataaaaatactatgagattatattgctgagttagcaccatgagaacagtgtttctgcaaattttttcttctaggtgcccaccccacagcagattcttcaccaatatttgttagaatttaaatttagcccaattctttaaataagaatgcagagatttcatggtctaagaatagaacaatcagcactctttgtgttctattttactgcttcataaataaagttcttcagtccaagacatctgaacatgtatcagaatattcactaattattgtgaacatattttaaaatggcttaggctacagattctttccttacaaatccatcccattgtttggggaatccaattgtagggtgcttcatatcaggacaaaaaaaataaattagtaaacttgtttctttttctaaaaacgtcataatagatttgcaattttccattatatatttattcagcttatttttggaagatgttggtcttgttaagatatcactgagaatactacattactatgtacaacttatattctgggaactgtaagtaacatttagctgcttaccccaaatggccaagtaaatgaacaactgttatgtcttatcttagaaataaaggttcacataatcatctttcagtgcagagtattaacatttgtttgagaagagctcttcagtagaaaatatagctaatatagacactattattctcaataaaaccaaaacaaagctgtaactctgagtctgttctctttcaccccattgcctctgtaggagaaaacataacgaaagctccagtgctcagcaccagctcatgagcacatttgcctcacttagtgtttaagattgtatgcagaagggcttcatttttagaattaacaatggtgcaattcttcattaaaacatgtatgcctaaagaacatgagcagacacttttcaaaagaagacatacaaatggccaataatatattaaaaaatgctcaacgtcagtaatcatcagagaaatgcaaattaaaaccacaatgaaataccatttcacaccagttagaattgctattattaaaaagtaaaaacttacagttattggtgaggctgcagagaaaaggggacgcttatacactgatggtgggaatgtaaattagtttagccactgtggaaagcagtttggagatttctcaaagaacttaaaacagagcttccatttgacccagcaatctcattagtgggtgtatacccaaaagaaaataaattgttctacgaagaaacaacatgcacttgtatgttggttgcagtactattcacaataacaaagacaagaaatcaacccaggtgcccatcagtggttgactggataaagaaaatgtggcaaatatgcgccatggaaaagaatgagatcatgtcatttgtggcaacacgagtgcagctagaccataagtctaagtgaattaatgcaggaatggaaaaacaaatactgaattttcttgcttacaagtgggagctaaacatttagcattacacacggacataaaagtgggaacagtagatactggggggactattacagcggggaaggaggaaggggacaagggttgaaaaattacctattgagtactatgcacctgggtcacaggatcactcatatctcaaacctcagtgtcatgtaatacccccatgtaacaaatctgcacatgtaccccctgaatctaaaatgaaaattgaaattaaaaaatgtcttccaaataattttttaaatgactatgctttctacaaaaatagaagaaaaaaattttaaaaaaattccctctgggttaaacatggtagagaattgtcacacaaaagaagcatttgccagccatcatttgcaaatttcaagatgtctaggaatctcataaggaaattgtttaaaatgattatttacagcctccactgccagagattttgatctcatcaggttgggatccagggaactccagagactgcatgcatcacattttgacaaacagtgaaaaagaatcctttttttctttgtcttccacgtgtttaaaattaggcagagagttggtgtttcctctttgtgcatacaactagactagatttaccagacattgttacataaggcatggccatataactgagctgtagacaatggaaagtgagtggaaggcaattattggtcctgactcataaaaccttactcaacacacttgtccaagctcttttcccctttcagcctagcttaagtggaggtgaccactatggtggcattgaaagtcaacaaaatgtataggagcaaacatcttctaagttagcagttctcctcaacttcagcacagacacaaatcaaatcatatgcttgttaaacccacagattataaaattctaccaccaaagattttgatttgataggtctagaagaaatgcacaggaatccgtattttaaaaatcatgaggcaattccgatttgtgtgattctggttctataagttgagaagcactgaatgtgtgtatgtgtgtatgtgtgtgtttaagtaatagtgtagttaatgctagtgttggttactaattatatgtcacttatcaaactacatctatttctgcatctttttatatatttattttagaagacaataacattataggttacagaaaaaactggatctccagaaatcacattatagattacagaaaaagaaaattggatctcaagaaatcatctagtttaatggagatcctaatgaaggcagatgtctaatctcactttttctcaaactaaataataccagctacttcaactcttcccttagggtattattttatatgtctataatgattttatcttttttttttctgagcactctccatattctttacctccttaaaaaataaggagagcaaagtaaatatattgataaatgttattaatgcagagtattacacaaaaataatttataggctttacataagtagccattatttatattatatgtattttaaatacagaggatattatttaatttccttaatgtattggagactttaaaatgaaaagtacatgtatcttgttcatttttatatgtctgacttacattggttatcttttgcttctcatatatttattttgctttatatctatatatctatttatcatctgtatctatctatcttctatctatctaattttggcgttttatcttaaagtttaaaaaaatctatggcactatatacacctatatgaccttgattctcctccagtggtttcctatttgtatgttgaggagctattatattttagacaagaagcttggcattttatataaatttcatatttcaaatagcaatttatattgcctattatatgacagatggagaaatgagattgatatgtaataacttacttgcccaatatcatttacctagtaaattgcattgtaatttaacatgttttcatgctcttttgtcttaaaaaaattaaagcttatgagaaaaatttttataatgaacatccttatatagataatttttatttcattatgaaatgaattttaaccagaattatgttgtctttgagtggaagtcaccataatggcagtctacaattatgtttattagtctcgtccattgaatcaaggtgcacatatttcccttctagaaggctactaataataattttctctcaatgcttttccactttgagcttaaggtgctcccgaataaattactacactaaatcctgccatcaaccaatgcaaaagaggaagcatttcaatgcatatataatttgtatccctacttgaaatgcagcattagatttctagtcacctcatattggattattcttatttttgggtaaaattcagtttatgtactaaagattccatcaccaaagtgaaaatagttgggcattatattacattatctgctaccttcctcagagcaggaatttttattttgcataaaaatgtcctttgtttttccctgagtattgaaatgttcatggtttagagtccaaatctctaaatgagatcactagcttgtatttactatgctaatttatcttttctcatagaacaataccgggttttctctgtgactgctgcttttcagtgacgtattgatctgattttggctaaacaatacaatattgctaaaatctggctaagaagaggaccatatcagataattcagtagaactgtatatcattttctattagagaatttatgttttccccttgaatagtctatttttcctaagtttggaccatattaaatatgcagatgtacaaagaacaactataagcaattacaacatactagatatgaaaaatgttttgataaaaagtctattaggaattatatctcctttctgcatctttcagaaattagttttttacttttcataagttttacttttcatagttttcttaagattacttaaagagaatatcttcttgtcattgtgaaatcgataaaatataaaagccatcttatatgcgtctgtttaaacctgctgaaacattataatgaaattgaaaatcaccatacattgtgtgcaataaaataatgcattattagttatattagcactcagatcattaagaaaataaaatgttctttatcaaattttcaagtcaaccttttgctctgaaatttatcactgcagaaaatatttaaatgggaagtctgaatttaatgcttttgtatctatctgttcttttcaggaatttgaggcattttgttagttttccattaaccacaaatatatatcttacatttcaccataagatatgaacataatttaggagacgaattagttcaaaacaatggaccatatttataggatcattaatgcaaataaaggagcagttgtacatttattccaaaattttatctgaaatttgggaggttttgtggtgatggtagatggattagggatgatactcttcctatacagatttcttgctctgcatggatgtatatttgtaggtgtgggtaggtgttgatgtctacttgacagtggagggtgggaggagaggagcagaaaagataactattgtgtattgggcttaatacctgggtgatgaagtaatctttacaacaaacccctgtgacatgagtttacctatgtaacgaaccttcacctgttgtttaaaaacatatttttgcattaaattcagacttcccatttaaatattttctgcagtgataaatttcagagcaaaaggttgacttgaaatttgataaagaacattttattttcttaatgatctgagtgctaatataactaataatgcattattttattgcacacaatgtatggtgattttcaatttcattataatgtttcagcaggtttaaacagacgcatataagatggcttttatattttatcgatttcacaatgacaagaagatattctctttaagtaatcttaagaaaactatgaaaagtaaaacttatgaaaagtaaaaaactaatttctgaaagatgcagaaaggagatataattcctaatagactttttatcaaaacatttttcatatctagtatattgtaattgcttatagttgttctttgtacatctgcatatttaatatggtccaaacttaggaaaaatagactattcaaggggaaaaacataaattctctaatagaaaatgatatacagttctactgaattatctgatatggtcctcttcttagccagattttagctcaatatcactgatcattaaggaaatgcaaatcaaaaccacaatgatactgtctcacacctgtcagaatggctactataaaaagtcaaaaaatagcagatgctgacaagattgcggagacaagggaactcttccctgtaataggcagcaccatcattaaatcatttctttagaaaacaaaaatgcatttttttcatgtttgtgatgtttgttggccatttgtatgtcttcttttgagaagtgtctgtttaagtcctctgcccactttttaatggggttgtttttctcttgtaaatttgtttaagttccatatagatgctggatattagacctttgtcggatgcatactttgcaaatattttctccaagtctgtaggttgtctgtttttatagtttggggttttacatttaagtctttaatccatcttgagttcatttttgtatatggtgtaatgaagggatccagctttaatcttctgcatatggctagccagttaccccagcaccatttattgaacagggagtcttttccctattccttgttcttgctagctttgtcaaagatcagctggtcataggtgtgcagccttatttctgagctctctattctgttccactgtaaaccactttttaaaaaataatgagccctttccatatattctaattgtgaatcttgatcataattatattatgcccagcttatgttttacaaagtgttaaaataagctctgcatgagttcattgtaaaaaaaaaaaaagtgcagatttgtatttaccccatgcatatctttgtacactttctgctcattactacgatcctacccagtctccacaaacacacacagatgtggctttgatattaagttttacatttgcttatatatgtatattctttaaaaaacacaggaatgtatatatatatctgagaattgctatttcaaaaatatatgtattactgaaaatttcagtgctagtaatacatattgtcacttttttactggctctatagttgcagttatataaatctattatattttactttaatatgttcctatagatggacatcattatgcccaaatgataattttaaaaatttagttttatgggctgggcatggtggctcacgcctgtaatcccagcgctttgggtggctgaagtgggcagatcacgaggtcaggacttcgagaccagtctggccaacatggcgaaaccccatctctatgaaaagtataaaaaattagccaggcgtggtggggggtgcctgtaatcctggctacttgggaggttgaggcaagagaatcacttgaacctgggatgcagaggttgcagtgagccgagaccatggcaccgcactccagcctgggcgacagagggagagtctgcctcaaaaatatatatatattagttttatgatcatctattaatacaattagttatcatcaccaatgatttacgtatttatgatacttttacagttggtcttctatgtttacagacaccgtatccataatttagctctgaaagatgattaatgccagaaactgtagagcaattaacacacctgaaacattttatcacaagtagaaaaaaaagactgattgcctatcagacaatattgaaaaattgatatttttattactataactgtttgaatgttttacaatgaaaaaatttcattattttgatcatgctactctgttttacttaagcattttagtattttaaagaggtaggattgtaatccctgaccctgttttttgtttttcgttttgttttgttttgtttttttaacttcaacttttgttttaaagtcacaagacacttaccggtttgttacatagatatattgcgtaaagctgaggtttgggttacaattgattgcatcacccaggtagtgagcataatgcctaatagttgttcagcccttgccctcttcctctctcctgcctcaagtagtccccagtgtctgttgttcccatctttatgctcctgtgtgctcattgtttaactcccacttattagtgagaatgtgtagtatttggtttcctgttcctgaattttgcttagggtaatagtctccagttgaatccatgttgctgcaaaggatatggtttcattcttttttatgactacatagtattcttccatggtgtatatataccatattttctttatccagtccaccactgatgggcaccgaggttgattccatgtttttgttattgtgaattgtgctgtaatgaacataggagtacatgtgtctttctggtagaatggcttattttgggggaggggtatatatccagtaatgagattgctgggtccaaggaactctattttgagttacttgagagatctccataacgatggctaaattaatttacattcccaccaacagtagataagcattcccttttctttgcagccttatcaacgtctgttattttttgactttttaataattgccattctgactagcatgagttagtgtttcattgtggttttaatttacatttctctgatgattagtgatgatgagcatttttttcatgtttgtgatgtttgttggccatttgtatgtcttcttttgagaagtgtcttttcatgccctttgcccactttttgatgggttcttgttttgtttaagttccttgtagattctggatattagacatatgccacttgcatagttggggaatatttactgccattctgtaagttacctgtttactcagttgatagtttcttttgctgtgcagaagtttttgaatttaattaagtctcacttgtcgatttttatttttgttgcaattccatttgaagacagtcataaattctttcccagggccaatgttcagaaaagtgtttcctagcttttcttctaggatttttataatttgaggtctgacatttacatctttcatccttcttcagttaatttttgtatattgtgagagataggggtctagtttcattcttctacatgtggctagccaggtaacccagcatcacttattgaacaaggagtcctttaacaaaattggaaaataaaattatattgacaataagttatttcataatacatttttgaattaggagtaattttagaaatttacgtgaagacagtagatatctataatttttatagaacacatcataataacaccttcacataagtccaaaggtactcttcagaaataatgactatatttctctgaactatttttagtattagctcttcaattttaactttgaattttaaaattatttgtatgtatgatattaagtaaagtgttcaaacaattttttaatgaataaatctcctgtaagtatttgtttgcaggtttttacatagacaggagtttgcatatcaattgagtacatgcctaggagcatgagagctggtattgcatggtaagaccatgttcagctttgtaaattgccaaaatgtcttccaaagtggctgtaccatttgccttctcactatccatgaatgagagttcttgttgctccacatttttaccagtaattgatattgtcaggttggattttagtcattctaataggagtttggtagatttctgtgcagttttaccacataggatgtttaagcattttattgtttagttgctttttttcccaaaattttattaatggaaccacgttttatggtgacattttgcttaaaaatgttttgctgagttattggtggatacatataactgcatgttcttaattttcagttctgtatattatcccactgtataaaatgtaacacaatttattcattttattataaataacatttgagttgattccaatttttcacttattcataacacatttatagtatttatcatacaaatcatgcatatgttagatttattcctagataacagtgatcttctgtggtcactgtaaatagtgccttgtttaacttttttcagttctcatcaactgacatacgtatttatctgttttgttttgttttgttttgttttatcctcctcaatagaatataggctttttgaaaacagcgttaattgtttgtgttgtttactgatatacccctaccacacacaacagtgcatgacatgtaagagaccctcaataaatatttaagttaatgaatgatatagaaacataattgagttttccatgttatccttatatattatgaccttgataatgatcgttaattctatccttatgcactgattgtagatacatctatttttgctttaagtgtgttgagactatatttgtagggtatacacttttggtattgctctctctttctagtgaatggaaattttaatcactatgtatttatttctaacaaatattttaattaaagtctattttgtccaataataatagctatatccatttttattttgtttgccttttatataattttctaccctattattcaaaccttacatgtccttatgcattatatgtctattagactatcatgtaattcactgtaatccaatctgataatctctttaacttgaagtatttattgcctttacctcgtttgaattataaatttgagaacaattctattattttattttttacattatatttgtcctgacttttctaagtagattttttttttttaacttttagcctttctttggctagttgaggctttaattcccctttttattttatttctttctctctactagtctttgttttgttttgttttgttttttgaattttgatgtttcttttttttatactttaatttctagggtacatgtgcacaacgtgcaggtttgttacatatgtatacatgtgccatgttggtgtgcttcacccattaactcatcatttacattaggtatatgctatccctcccctaccccacgacaggccctggtgtgtgatgttccccttcctgtgtccaagtgttctcattgttcaattcccacaaatcattttctgttttcagtgtttaccccaaatattttcatgtgcaaatttaacatataaaagcctaaagttatacaatatttttaccatctttcttctaaaccaaagatccttagcatgtgttacctccagccaccctactgttaacataaatgcctttactgtccagaaatatatttaaatatattaattttgatgctacaaattagatattgttgtttaatacagtaagtgtgtatttagatctacatttattttctaatttgtatgatctctgttatttccagcatcataggccttccttctcagatatttttctttattcttgaagtatagaagttatgtggtgctttagggagtatttgttttttgggtttgtttatgaagggtttgtgtctatctgtagatatcttaatttccactctaacttgtagaaaatagtttttttggggagtatctttctagctttataaacaagttttttccttctctcctatgtctctggcttccattattcttgaaaagtcattgtcattttaagtgtcagttttttgtatagagtatcttttctctttgacttcttctgtaagttctatagtttcactaccatttgcctcattgcagacttctaaaaaaatgtatccttgttgttctttgagattcctaaaaaggcaaattcacatcattaatcaattctggaaaagtcctagccattactttctttcaatatcaacttctccctctcatctccctccaaaatgttttttctttctcctgtttttgttaaactttgtacctttcatctcctggtcacttcgttcctggaaacacacattagtgggaacactaatttgggatcaattaaaagacaatttcagatttgaaatttcagatttcagttcaggtattttgaattatattggtattgttagttataactctaaacttgtttaaatgttgaattatggtcagaagttcttagaggaaactttttgattcttctcccattgtcttcctatcagagtaattttttaaacttagtttatttgcagagtgtgttgccttttgtgggggcttgtatggggttttaatgtgggttttaaatttaacctatttgctgaggttccagattttgcttcttatccctcaagcactttggtcattatatcctaaatctaggtcaacagctatcaaaagatacctccagggtaaatgccactttcagcatttgatatggtaagcacatatggattactattttattatagtttctgacctccaaggaatatagttgctttctcaccacctaagcaagtatttaaaaaggcatttcaaaaatatgtcatctaccatttttgggacatacttatctgaacatctatcatccgtattgctttattacacagatttaaaattttattattgaaatatgaacccattatttatataaaccctttaaaattattttaaaaatattgatgtatgtatttaataaatacataccctgcctgtctcctttaagatttcaaaaaaatactatatataaactatagcattatcaaagtatggataaaatatcaaaaaccatacagtagaaagtaaattatactaaagcttatgcaaataatacttattaaaatagagtgttgaacttaatagatttgacttaaaagtgtggctgccaaaggtaataggcataaggaaacttaataaggaaaaacactcagataccaacacttcccagcatttagcttgaaaagctgtgtgtcacaatgtgaagcgacattttgaaagatataatagacaatagcttccaataactttataaaacagaggaaacagtaattacatggctatttttaacttttattctcaatgtccatcagataatttgaaattaacattcattggggacattattacaagttaacttaatgtggaaaaaggatgaagcattctgatgattttctttaaaataaggaaacatcatggaaaattagataaatttattattagcatgtatctgaaataaataataccacccagtctattctccaaaatattaagatatatgtatttaataaatacataccctgcttgtctcctttaagttttcaaaaatactgtatataaactatagcattatcaaagtatggataaaacactctttataagtgttggaaaatagttaattttagattaaacattacagtgaatttctcagttgtgggcttcaatgagttaaattttaaaactatgcaatcccttttttttttttgagatggagtttcactcttgttgcccaggctggagtgcaatggcgcaatctcagcttattgcaacctctgcctcccgggttgaagtgattttcctgcctcagcctcccaagtagctgggatacagatatgcaccaccatgcccaactaactttgtatttttagtagagatggggtttcaccatgttggtcaggctggtcttaaactcctgaccttaagtgatccacccacgtcagcctcccaaagtgctgggattacagatgtgagccaccgcccctggcccaatcatacgctattaatagcatattttagattgaaaatcctaagaaaaaccatcagataacaattttatttatcaaagaatggaggcaaccaagatatccttcattaggtaaatggataaacaaactttggtaaatccatatgataaaatactattcaatgataaaaagaaatgagctgtgaagcctcaaaaagacatgaaggaaacttaaatgctattgctacaggaaggaagccagtctaaataggctatatactgcattattttgatgatataatattctagaaaagatgcaattatgaagataaaaatagatcagaggtttggggaggggggtggttaaatatatgaaacactggggattttttagggtagttaaactatcctgtataatattgagctggaggatacttgaccctatgcatttttaaaaacttctagaactctataacacaaatggtgaacattaatgtatacactttaagaagtcagggtatacctaataaagtgcaaaatgacaaaaactattaaaatgtataaaacaatctcactgatgggggtatagatttttttattttgttttgcttttctttttaaactgacctaagtaattttggaaatgaagggagattgtcaagagtaaagccaaaagaaactgtatataactactaggttctagttgacaatgttggttctcacattagaaatttaacaattatgaaatcactatacttgtacatggaagtggaacaaataagtaaatgggtggcagatggtagaagcgaagcttctcactgttaaagtgggaagttacatataagcaaggaggaaggctagaataaaccttgccatactggattagagttggatggatcaatatgacttcatgtttagcttaattagatactgatagatatacctagcaatatttataggtatgtgctagtatgcatgtgagttagtgttcatgcatgtatttcctaacactgtcccttcagagggcctagaagcgatgataccccattagcaatgagcacatccagcaccaagatcttggtttctaataccatcctccaacgaaagaaaccagcactccttagtgaaatgcatggttatgggactaggacagggtatacacaagatgagactatcctgtcttgtcttgtggtaccagaaagtaaggatgtgctcagtaaagaaaactatgaaggtttgtccaaaggacacggaagacaactgaaagagctccgaatattcaaagctggaacaagttgtgcaacagaataaactgtattggattataaccaaaagtgtaaaataaatatctatgagtttgtacttatataaatacattattgaataattaaacaggtgggggaaatagacaagttttcatgcagaagaacaccaaataaattatgtagacactgttccatcaagatgttggattataactccttactgcttatgtgcagactacacactttgatttaatttcaaagagtagagtaatggactgggggagagatagtaattgtacgttggagaaatctgacaagcactaccttaggcaggtgattagtgataagtcatgttacctttaatatgatgtgctgagaatgattatctctctggtttttgtctccaaaatccactaccctagtgtaaccatgtgaaaaacttctgaagaaatccaaatgaagcatagagtttagttcatggtaatttatcaagatggattcattagctgtttcaaatatatcatactaatataagatgccagtaatatggaaaaatgggtgagaagtacaaaggaactcattgtactgcctctggaactgttttgtgaatgtaaactattctaaaatggaaggctcatttgcatagaaaataaaaggaataatgaaactaaaatttgggatattgattacttctggcaggggagggaaagaaataaggcacatggaggcttcaaaaagattatcaatagttcataaagtgggtgatgtttacatttttattttttatttttatattcatgtatacttcatgtatgattttgtatgttgatatgccaattatttataaagtaacagtcgcctaaagaatacgtgatacagaaatggaagaaattctaagagataagtttatcagagaggtttctctgggaggtaatacttaatcatttggccaaataaataattggaatgctaaagctataattgatttggaattgaagatggagtatgacattgcaattatgtgttatgcccagtgcctttgtaagaggaaagatagaaaggttgtctttcagaagtgagaaatttatttggcagggcatttgaaagggtatgctttgagaattatgcatgttaatttttctcataaaagtgaataataatgctcatagtgataataatagctataattcatgcctattatgagttaatcacaagttgactgccttccaattcttctcaaaggctgtgcatggataattgataatcaagagagatgttcgataaacttattgcctgttgttgatattattactcttactgtacataaactgcgatagactgactgatgccaccactaaagatatccatgcattaacccccagaacctgtgcatgtgttaccttacgtagcataaggaactttgcagagaggcttaagttaaggatcttaaaatggggagatcatcctggattatctaagtaggcccaaataatcaaatgggttcttgtaagagggatgcagagggaatgggaaaagatgtcacagatgtctttggcaaaagatgtcacagtggaaccagaggttgaagtaatacgccttaaagaccatggaaggggctcaaatgcaggcatgtgggtggcttctacaggctggaaaagacaaggtaacaaattctctcctaaagtctccagaaggaatgcagtcttgctgacaccttaattttggacttctgaattccagaaatgtaggggattaaatatgtgctgtttcataccactaactggtaatttgttaccctacaataggaaactaatacattatgtcatgaaacctcaccagaactctatagattggaactcggattcctcaatttacagataaagaatcagagtctcagctaaattaaggaatgtatttgtattcagcttctcttctctgttgagtggcaaagctgagatttaaatcaaagtctctcttcctctgaagcctataccctttcagctctaatactgccagattagtgcagtggtcctggagttaagctgtctctattggaatcctactttactacttgctgggtgaagttagttaacagcttgggggaagaatagtacttttttttttttttgcgtcagattcatgataaaatgaataacagtacttaacctgcattattgtcaaaacaatctaagtatttagcagcataccttcatatctactgaaatagcctgaaggtcttttaaaccagaaatgtccaaaattgaatttattatccaaactctcaagctaccccacctccttcctatattacttctccatctttttttttttttttttttttttttttttttgagatagagtctcactctgtagcccaggctctagtgcaatggcgggatctcggctcactgcaagctccgcctcccgggttcacgccattctcctgcctcagcctcccgagtagctggaactacaggcgcccgccaccacgcccagctaattttttgtatttttagtagagacggggtttcaccctgttcgcaaggatggtctcgatctcctgaccttgtgatccacccgcctcggcctcccaacgtgctgggattacaggcgtgagccacagcgcccggccagttctccattcttatggcttcatcatcttacattctctgcatctcgtcttctcttctgacctcctactagatactttgttatccatgacgcccccttctgctgcacacacatgctagaaatctaattgttcacatgtgaaattcttcacttggaatccaaatatagttatcatgtctcatttatatggtcacacctctcccccgcttctctctcccacagtctagaggaccctcccgctgttattaacagtattttcaacatctcagtctttaccttccccttgatattgtcgaagataattttcttcaagaggattcaatttacttttgctttcaaatgctagatgcctcactgccctttatgttggtgctgaagagaggcctggtgcttgtttgctctgcagtgatgctattactggtttagtcccaacacaggtcacacgtgcctctgggctcctgcttcagggtgatagcttcactggttcacatcatcatgctcagccattgtttcctagaactgcacacaaaagacagagcggtgggtcctgaatggtcacagtcttaacccttgtctcttctagagccaatcagagccaacccttaagttccagttctgagtctaagaaacaatgcaggtacacatccccatccccaatttttggtgagttccattttagagccctttcctttctttagattccattctggtccacagtgccagagcttctgatatttgatcagtgtaaaatagatcaacacttcattcctaagatgttcaaggttgtattcagagaaattccgcattctttatatatgatatcttcaacaattttttttcttacacttcttatgcacaccaagagatattcaagaagagtagctaaaataagccaaataaatgatcctatcaaaactttctggggacggtggttacctagtcaccttatacaaaatcccataaaaaaaatctgctctaaggttacatacatttccaaatatggacaataaataggtgacaaggtttctaaaactgagccttattaggcattctgtttcaccttgtcactgtatcacccagctctgatctctttcttcactgtcatattcttcattcaagtttgcctcacctctcacttaagaattgcctcagctcctagccaatcatcttgcctccagactctccctttttttgtctacccactactttaacagttctcgaaacaaacataatggattatttgcttttttgtttaaaagcccttttttacttctcattacttctggaatcaattccaacttacttcaatttattcaagacaaggtcctctagaaaggggctacaacataactttctactgttagctcccaggaccatcatcctcagatacccatatctccttctatgtactaaaatccattttctccaaagtatgtatatagtaataaaaatctacttttaagacggaaaagaaggcaagtcctttctttctacattggtagtttacatattttatgagataattaacatatggatttcatatgtaggttaaaatgcgttcaggatgaaacactgagttttacttgacaaaaggtattgtgaattggtgtttctcaaaattcaaattttatgaatagtacagtgaaacagtaaacatgttctaaggctgtgtttaacattgaaggttgagagttctaatttattttgagattacgaaaaagatgtatatttaaaatacttattttagaacaagattggctggcatactttatgtatacagatttagaattttgtaaattcatatgatacagcaataagattgtgaatgaacaaagatgttagttcagtgcacatttttctttagattgttttatttgattctaggatttttaaaaattggcaatcgttacacatgatgaactattcagaccccttaaaaacatatttaaatggaatgaataaaactatggatattgcattcctattagattttacttgctttaaaaaagcatgtagaacaaaatatattcaaagatttacataagccagaaacttaagaaatagtttgagattaaagactatttcaaatagacagtatttttccatttgatctattaaattttcaacaataaatttcaattaaatttggtcattccaaaaacattggtcaagcatctagtatgtgtcaggcactgtgatcaatattggggaaaagagaaaaaaaaatctctttattattgaggagtatgcagtatactcccatgtgggtttagacagatatttgaacaaatattcataatataaactaataattcctataatagaatgatataaaaagtatttatgcaatctcttttgtactttagatggccatcatatttttgtttctttcctattaagttaatggaaataaattacaatgcaaagaagattagttgtgttattgaattgacccacggaaaaaaaaacattatacagaattgctctgcttgttgcttatgttcaaggcaaacaaaggtaaaatattatatttaaaatagccgtagtacatacagaattctcaaaaagtaatttaatgataaatacttctagaagtagtgacctcctattttcaatatagcatttatatactctattttaatttgctttttcaagttattagtggctttttcagccattatccagactaattttggtacataaaaggtataatcacagtgaaaattgacttttttattcaacagaaaaaaagtgttgtgagctattttccgtataattcattaaaattataacttaacagttttcccttttcaatattctttcaaagttagcatttcagtctaaaataaaagtgagcatgtaggacattaattgtacttgtctgaaatgtagttatctaaactaaaggctttaaaagaattattttccattccatatattaaaaattcatcttctcaactcatttaattactgagaattttcaaggacttttaaattatgtttccataaaattcaccacatcttaggatgagtgtttatttcttattccatgaaacgtccattatcagcataaaccaagcttgcaaattagaaatagtaaaaacaactttactatttgcattccattatccttgtacatggttttaggcttaactagagaaggtatctgcagttctcttgataattttttttctctgccatcactcatctagatatttatgtgatcttaaagtggttatattagagagagaaagagagagagagagaaagagagaaaaaaaagagtactggttttggttagatttgatccaaagacaaatttttagaaaatgaagctagaagctaggggtcttgaataaattggcctcacgatacatagttaagctgaaaagatttagaatttgaattcacatataatatttactattgttggaataattataatgagcacttagagatatgttttcttttgataagctttgtccatgtatcccaattaatgctggcttggtatgatactaaaacctaaaataacttattttgagcctatgtccttattacaattctagaggaagcctcttataaaatgtgattagaacacagtcatcaaagcaggggatcatttaaaaaatgatacatgcaaaacttagatattctaactttagtcataattgcatagatattacaacattcatcattcttttgatttagctctaaacccgatacactttctctttagtttgggggactcacaaagactttcttgactaagccacatacctcatacattgtatataaattttcattttgattttttagagtgggatacatgactattagaatcaattttaagatacaatcctaagtttttattatttcccaaaacatttcatagttgtcttatgcatatctgtttttccagcagcgcatctctatagagacttcccaaagcattcaaattaataccctagagctattacttccatttctcgttctagtacatttgctcactttacaaataaattatttaagcacaataaaagaaaaattggtaatttatttggggaaacagaggctactgattctggatgcccaaaactcactttggagtaagtgagcatcagtgagtatataacattttttctttcctgaataaatacattaaaaagaggcatttttatgttaagcaaaagttaatgtgttgagtccattaaagagataatgattaatttttttcaggagcttagattttaaaatatatgtttataagagaaaatgtaatttcctaactctttctactttaaatataatcaattctgaaagtaaatatatttaaatacactatgttataaatgaaagtttatttaaatgcataaaactgtgcctacattattttaaaatatggatacgtatctatttttgagattcagtaaaaataagaaacaaatgcagtaaattccaagatggcatttgctatttttcagcacaaataaaactatgcaaattttctgtttcaaacgtaaaatgccagtttttgattttatttatgttattattttttaaaatttcaacttttattttacatatgggagtacgtgtgcaggtttgttacatggatatattgcatgatgctgaggtttaaggtatggatcctgtcaaacaagtaataagcatagtacccaatagatagtttttcaacccatcacccttcccccttcctcccccctctaatagtctccagtgttaattgattccatctttacgtccacatgtgctcaatgttgctcccacttacaactgagaaaatgtggtagttgcttttctgttcctgcattaattgtcttaggggattatggcctccagttccaaccatattgctgcaaaggacatatggtttcattctttttaatggctgtatagtattcttccatagtgtatctgtaccacgttttctttatccagtccaccattgatgggcacctagcttgattccatatctttgtgattgtgaatagaactgtgatgaatatgcacatgcatgtgtctttttggtgtaacaatttattttcctttgggtatatacccagtactgggattgctgtgttgaatcgtagttctgttggaagttatttgagaaatctccaaaactgcttttcacagtggctgaactgctttacattcccatcaacagtgtaaaatcattcccttttctccatagcctcgccagcatctgttattttttgactttttattaatagccattctgagtagtgtgagatggtatctcattgttattttgatttgcacttccctgatgattagtgacgatgacaattttttcatgtctgttggccacttgcatgtcttcttttgagaagtatccgtccatgcccttcgcccttttttaatgagttatttggttttttgtttgttgctttaagctccttatggactctggatattagaccttgttgatgcatagtttgtgaatattttctgccattctgtaggttttctgtttactctgctgatagtttctattgttgtgcagaagctcagaaaaagagcttaactaggtcccacttgtcaatatttggttttgttgcaattgcttttggggcttagccaaaaattctttgccatggctgatgtcaagatgggtatttcttagcttttcttctaggattcttatagtttgaggtcttatatttaaatctttaatccatcttgacttaatttttgtatgtggtaaaagatagggctccagtttcattcttctgcatttggctagtcaggtatcccaacaacatttattcaacagggagtcctttccccattgctaatttttgtcagccttgtcaaagatcagatagttttaggtgtgtggacttatttctgagttttatattctgttccactggtctatgtgttcatttttgtaacagtgccatgctgttttggttcctgtagccttatagcatagtttgaagttggagagtgtgatgcttccagcttttaatactattgcttaggattgctttggctattcaggccttttttggttccacatgaattaaaaaattttttttctaattctgtgaaaaattacattgatagcttgatagaaatggcattgaatctgtaaattgctttgggtagtatggcaattttaattatattgattcttccaatccatgagcatggaatattttttatttatttgtgtcatctctgatttctttcagcagtcttttgtagtccctttgtagagaattttcatctctttggttagctgtatttcaaggtattttattttactttttgctattgtaaatgggattgtgttcttaatttaactctcagcctggatattattggtacgtagaaatgctactgatttttatacgttgattttgtatcctggaacattacaaaagatgtgtatcagttctaggagtcttttgcgagtttttagggttttccatgtatagaattattttatcagtgaaaagagatagtttgacgtcttcttttcctatttggatgccttttatttctttctcttaacttactgctctggcaaggacttgcagtcctatgttgaataggagtggtgagagtaggcatccttgtcttgttccagttctcaagggaaatgtttccaacttttgcctgtttagtataatgttagcttttggtatgttgtatatggctcttgttattttgagtcatcttcctttgacacctagcctgttaagggtttttatcatgaagggatgttggattttatcaaatgcttttcctgtgtctattgagataatcataaggtttttgcttttaatcctgtgtatgtgctgaatcacagttatttatttgcatatgtagaaccaaccttgcatcccagaggtaaagcctacttgattgtggcgaattaactttttgatgtgctgttgaatacagtatgctagttttttgttttttgttttttttttagatggagtctcactctgtcacccaggctggagtgcagtaacacgatctcagctcactgtaacctcggcctccctggttcaggcaattctcctgcctcaacctcccaaatgtctgagattacaggcatctgccaccatccctggctaattttttctatttttagtagagatggggtttcaccatgttggccaggctagccttgaactgctgacctcaggtgatctctccgccttgacctcccaagtgctgggcttacaggcaggagccaccacacctggccatagtttgctagttttttgataagtatttttgcatctatgttcatcagggatgttggcctaaagttttcattttttggtgtgtctctgccagattttggtattggatgctggcttcatagaatgagttagggataagctccttctccctgacaatttgaaatagtttcagtgggactcgtagcagttcctctttgtaaatctagtagaattcagctgttaatccatttgggttgaggcttttttttttttttttggggttgatagtttttttttttaattactgattcaatttcagaattcagtattggtctattcagggtttcaatttcttcctgattaaatctggaagattgtgtgtttccaggaatttatccattttctctagattttctgatttgttgcatatagaattgtttgtagtagtctgaagatcttttgtatttctgtagaatgggttgtaatatttgtcatttctgattgtacttatttggatcttttttttctttgtttctctagctcacagtctatcaaccgtttttgttcttttgaagaactgttgatttcactgatgttttgtgtgaatttttacatctcaattttgttcagttattctccacttttagttatttcttatcctgggattggtttgttcttttcttctagttcctttaggtgcaaagttcagttgttaacttgagatctttctaacttcttgatgaaggcagttagcactaaaaattccctgttagcactgcccagagattttggtaagttgtgtccctattttcattaatttcaaagaatttttaaatttctgccttaattgtaatgttcacccaggagttattcaggagcaagttgtttaatttccatgtgtttatgtagttttgggagatcttcttgattttgctttctatttttgtattatggtctgagggtaggcttggtatgaattatattctgttgaatttattgagatttggtttattaccaagcatgtggtcaatcttaggatatgttccatgtgcagatgaaaataatgtatattctggttgttgggtggagtgttctataggtgtctactagttctaattggtcaggtgttgagtttaagtctagagtttctttgctagttttctgcctcaacaatgtatataatgctgttaatggtgtgttaaagtttcccactattattgtatagctgtttaagtcttttcataggtcaagaagaattcattttataaatctgagtgctctgatgttgggttcatttatatttaggataattaattcttcttgttgaattgtaccctttgtcattatataatggctttctttgtccttcttaattgttataggcttacagtctgttttatctgatataagaatagtgactcttggtcttttttgttttccatttgcatgatagatatttaacttcatgtccactacaaatttggttttacccatatatttcatatttttactattagctgtctttttataaataattgcctccttaatgcagttttaaacataataattgtttagagaagcctgtgggtgttgttatgtgtgagataggtccctcgaagatagcacaaggttgagtcttgtctttttatccagttcttcactctatgttttttaactggtgtgttttgcccatttaaattcagagttaatattaatatgtgacttgtttatgtcatcatcttgttagctgattgttatgtagacttgattttgtagatgtgtgattttaaaagtcatttagtttttgtataattaaatacatgactgcttctactgctactaaggagaacaacagaagctaacattgctatagcatttaaactaatttaaatctaatttaaactaatttaatcccttatgataattttatgagtgaggtactattactatgaccattttgtagatgatgaaactgaagcacggactaactaagtagcccaaagtttggggcctttaactttgtaagtggtagaggcaacatttaaaatgagggagcatggcttcatcatgttctaagccattaccacatttttacaaaatatggaagcaaattccatgtgtttgaattttaacttccaattgtcttctaccaaacttgtatttactaaaaagattaattttaatcacctactaaataaatccatgctagccgacttaattcattcagtcagaaaaatcaggttgtttagtaagagagctggtttaactttaattttttaaaactgtattgactatttgactaaattggctgggactacatgcaaaaacaactttgttatgaattagaagcttgggaacaagcattcttgctgagattccttagttagtcagttaatcaataacatttaccaaatgcactctgaggggttgggaaggtgaaaaagatatattagacatgtagtctcagacgataaagtaattacaatctagtaggaaacttatattcttgatctctaaacatttgaatttgatggttgattggtgatattattctgagatctttaagatacattacacagatcatatttttaaataatttttttattttactttaagttttagggtatatgtgcatgctgaaacgtaatgtgtatatgtgttatactctggttgtttttctacttgtttgatcctgttttttttaatgaatgatagttactcccagaaaaataatgaacacctgtacatataatttgaaaaagtaacacatattgtaccttttctttcacagatgactaaaacaataaaattaaacttagacaagcacatcttttattatgaataaacgttgttgagaatgggtttcaaactgaccaaaaatacttctaccttcgtttacatattcatgcatcattttcaaagaatatttgcaagaacttgagagaatcttcccagtgtttttttaaaaaaattgaaccactttttcttttaatgctgacttagtaatactttcaaacacccccacccacatttgactttagagaagacgttttagaagaaggggaacattttttgctcactgcaagtgtcatctgactatttttaaagatttattcatcattcattcaaggtagcataatgtcatgagaatgccagctttgaaattagtaatctgtcatgtcttctactggccactcttgcagtttgattagatgcaagtttgcttctctttgaacatttcagtttattttttctaagaaatgattatattgttcaagataaagtataaaattatgtagctatcaggagtatttattgagatatataccactgcagatgtgagaaattaaaacatttttatggcaagtatcttgacctgaaaaagcttactacttactgaagatagatggaaaaaatcaatctttatttttaagaaattactattcaacctaattgatgagtaagcctatggcagatattggtgcatattaaatacaggtattctcagaagagttacagaaccccaaaccaaattgttccctccctatatggtcttcagttgtagtttttgctttccgttaggaagatgattataatttaaaacatgttcatcttatgaaaaactgtttttcctcatctgcatgagaagattaacaaaggtgaagaatactgtttctatgacacttgtaggtgcctatattccaattgctaattatttttcaatctgatggaaatgcgtaaggatgaaagagctgtgttgctagagtgtgtttcattttgcttcagtaagcactgaaaaggcagaagatggcagggtaggtctttaaataggtgatttaaaaaaaatcttcctctttgtttttcttctcctaaaattacagagcagacttcattttatttcctagtaaatattccactgccagagttagctcatgttttgttattaactcaagttgttcaccagtttgcttgttcaactttctctaattcaggagattttatgtcgcacaggcttggagttttcttgattgccttgttaatgctcttatttcctagcaatcaatttagtttgattgatatttgttatgcagcctagttagttccttcacttgaatttcatttacaggtttttttttttaacttacttccttagcaatcagtttgtcttgattgctatttacttcctgacttcttgatattgcaagactgcataaacgtcctaattacctttatgtccactgcaaatttagttttactcacatatttcatatttctgttattagctgccttttggtaaataatagcctctttaatgcagttttaatgcatttgttgtgaatatagacaatggtttgaatgtatatttgcttacttctaacttagaacataaaacatgtatatattatcatgagatacattataactattataaaaacaatcacattagatttaaaaacataaccagggcaaaaagtgaataggtacatacaggtaaactgtggagacagccttaggctcccttagaacacagcaagcttaacctgaacatcaggtttatctctcaccattgggaattaaaaaacacaaaataccaaacaaaaactaggtcactaataatgttctctgtttctgagagtaatttcagacagcactgataaactgaataatgtcttcagtatttccgagagcctgaagcaaacgtctcccaatttaaattgcttcaaggtgaagcagaaacttccttggaatgccatatttctaatagttccctaagaaaggtaattaagtgtctattagattagaaaaaactgctttgcttaattctatgaaccgttgtatttattttaataaatattttaaccatcaaataatcctacaatgtcttaaaaacatgaaaaattaattctctagagggccccattcagtggctggtaaatagtagatgctcattcaatgtagataaactgttcttggatctattttacaatttaagacactcaagctgtgaatctttgcatgttccttctccacatttaggtgagagaatgtttcatctgctctctaccttaagcagactgttgtataatcctgccttctgctcaatatttatggagactagatccaatgcaagcgtgattgaagaatcgtaagggaagatgttctgcaaaatgagagccatgtctctacatctagtaatgttatcagtagttgtaaaactcacaatattcttccagcaagcctttctgcatgccagagtatgcaggtgccataagagctaaaaagtttcaaatttaagagtaataaataattgtatcattgaagtaactttagaatagaggcgataggttaactggcatttgtattaggaaataagagggtggtcaaataatcagagaaaacttagagaatgtgatttgttgttttcaatcaggtcttgaagaagcttatgaatgatttggtattaaagaaaagaacagtgaaacaatgttaggataacagtttatctgaaggccgagaggttaaagtgggcacaagagcctaaaatacaggaatttatgtaagtgcgaaaggacatttgcagaaaggttcagaatcattccctaagtaggattttaccttaatcaacaataaaatgatgctttttttaatgacatttaaagctttgtagtgtatgaatgtttcttacatctcttgcctcttgaaagaaatatttttgcctacactctaccattcaaattctagtcattctctaaggcccagtacaaatgtatatatcattatataagtagttataatattatatcttatttatatgatttatatatatttatattattcttatgtatttatatttataccaacattatttttatataatttatatatttcttaaacttcttttcacctaatatattgtaaggctacaccaccagcacagagcgatatctctttctggatctctcagcaattaatcatttattctattgatgcaagcttttagttttgttgttatttttaattgaggaatactttacatacaaaataaaatgaagatcttaagtgttcagttctatgagttttataaattatacacagccatataactacatccacatcaagattagaacattttcatcactcagaaagttctgttttgcccttttctagttgatgtcccttttctgaattttgttgttataagattagtttttctggttatttatatttatggaattgcattatatatatgttatatgtgtatatctagtatcttttaagtgacatgtttttaaagttcatgcttatatttttaacttttttcctgtgtatttccaagtaatatctcatcctataaatatacagtaatttgcttatccattttcctgtcacacatttgtaatgctttgtaatgtttccaatgagaaaatggttggtgtgtgttaattgtataagcaaccacaaaaacaatcttccaaagtaattgtactattttgcactctcatcagaaatatatgagagttccttttgctccatatagtcatcaacaattgttgttgctagtctttcttactcattgtagtcttttgtaaactttctctacaaggctttaggctatttttaattggcttgcttgtcttttcattattgactgttaggagtttattatataatctggatataatctttcattagagaggtacaggaaatatattttttctaatctatggcatgcctattcattttcttaaattcttaggtttcttaacattgtttgttggtgagcaacattttttaatttagatgaagtataagttattaatttctttcttgtataattagtgtcattgctgacgctaagttcacaaatattttatgcattcttctgaaagctatatggttttgaatttcacattttgtctatgttcgtcttgggtaaacttttgtgtatagagtgagataaaggccaaagcatatttatctccaaagtttatgttttccatgaagctttgtgagtttttaaagcaaatatactaatccggctcttcatttttcttagtcaaattttcacataatagcctatcttctcaatacgtttgtaagtatattgagaaccaaaattattttttaatatttttccataactttacagtgtggattttactttgtttttaaaaagcaaattgtatttgaaacaatgattccaaatattgtgcgcattaatattgatttgtgattgattaaataaatcaaaaattctaataggagtgttacatggaacaactaaagaaaactagaaaaggaaagagtagtatttacaagatattttcttttagaagcaaccttttgcatttagattgttttcgatgttatcaaaacattagataaggtttttcgaaatgtcaacataggtagcttcctggtcaacaaagccagcattactcctttatttacacaaaagaagtgggttcacagactggcaaagagtgatatctagtgggattaccttaatgtcttgatggcatatattctcatttatttaattttcactttgctgtatgattcctaccagttaagacaggaatgtaatgtgctaattaaattattgaaatagttaagcatattatatatctttttatggagaaatcagatgtagtgtatttaggaaaccttattacttaaattcaaattcattacttctgcaagtttctctggagatagcacaacaagcagtatcttttatattctcaaggaggttagagtctgatgctttttcttcgagatggagttttgcttttgttgcccaagctggagtgcagtggtgcaatcttggcttactgcaacctctgcctcctgggttcaagtgattcttctgcctcaacctctggaggagctgggattacaggtgcctgtcaccaggcccggttaatttttttgttttttagtagatatggggtttcaccatcttggccaggctggtctcgaaatcctgacctcaggtgatccacccgcctcggcctcccaaagtgctgggattacaggcatgagccaccacgactggccagaatctggtgtatttttaagcatcatatgtactcttaaacagtgtgttgtcctctacatgacacaagtgtatatgcggatgaaataatttagctacctgtcaaaacggtaattatttctagcaaaaaatagcaaaagataacctgttttccaagaagcccaactttacttttgtgaatgcctgaggattgctaagaggcaataacattataagtattgctaaagtggcaggctgtaaatagagctgactgagcaaagttgccatgggaaacttgtagacttttccaaaaacggaaactgaaccaaaagcattgatagtagttgaagtctggggtctgagagaaagtccttctgcctcctattgaatgtgcctaccaggctgctagagaataggtgggtttgtggacatatgctctgcttatctatccctttgcaaattcccttatatcagttcaccttcaaactcagcacgtcaggtaatgaacactgagaaatgaaaaagaagtttggaaatggaaatgaatcttctcatggaaaatttgtcttgaatttagcccgtaaagggtaatctaaaatggcttacagagaggattttataggacttttttaagttgccgatagggtccatgtttggcgtgctctctcctgctccttcatttgttttttctttcacgattgcccctgctaatactctccctctagttacaaaatgaaaaacatgtgacttgaagagggtttctttcctgaggacaaatgagcaacacttgaagtggaataccaattttttgaccctagccagcagtgcctgatcattccctcgcgtattttagcaactcccttgcctgctgaaccactaacatagtaaatagtagaatcctgctctcaaataatggccagaaaatgttcaattttggtttccttgcacaattcactaatacagtatatgtttcaataattatgttttacaattaagttatatcaaaactcctgacaataattgataaaaaaaatggaaacagtacattttggaaattaaatgtaggagctaattacttcaaaggacattgttgacagatttcattttaatgtagaaaggatatttattattttggtttataagtctttgttgagtttattaagcaatttgtgttgagaaagaaaatgtgaatctaaagatttagtagaacaaagtattaccttgttataataaaaatcctttaagttaaaatttaaggcgtttctaatttggaacctcatttctgagctgttcagatttaactgaatctatttttaaaaaacttaagtagaatatagcacattatctcttcccacccttttttaatgagtagtttttattgattgatgaaacaggagttgtgttagaaatattatgtgtatacttttaggtaactgagcaccattttgatatcaatcacattttaagagaaaataattgcttatctttaatgagagtttcttctattactgatttttattttaaaagtacaattttctgacaatagaaacatttttcagataacatgtacttatactatacactgcctgccaatagattttgcctttcctgattaataatgttggcttgtgaattctaaattccaaagggacatattttcacaaacagaatcagtgacatattaaaactatacggggttaactcataaaatgctctcacaaaatattaccaatagattctattccaacttaaacagaaacttaaaaataagttcacattatggacaaattaaatagatgaacttaatgattgaaatggccttatacttttataaatagatgaaaattaatggaaaaaaatatattaggtatgtattaatgaattaattttcaaaaacagagtttttgcttcataatgactacatatgtaaaagattttgtagaagttgtactctaagtgtaggttaatagacactaaattattttcaatagacagaacttagccacatgatcctgaaaacatattctaggaaaaatttaaatattgtgttatattggaaacagggaagaattggaagaatgggaacaaagttatttatttaatgttaagattcattactaaaaattaaatatttgctgacattatagttttatcataaaaataaggatagtgtaacaatatctatgatataatatatttaaaatcatgtatttaaacatgttgtgaaagaatttgttccctatactacaaaaggtttagttaagtcatattaatgaaaataattcaaatggctcctataatgtatattttgagtgaatacatttatgattataaatcaccttaaatttttcctgtaaagaaagcaaaatgtatctgtgggcttaaaaaaaatattgatcacttaaaatgaaaactcttgtgagaaattcttgagcaatgttggtttcaaaggctctttgacttcaggagaaagaatatagaaggctactgaatttacattttccattatttattttccaaattaattaatagaactagatcccaccttctttatatttgggttgtattgaatattggatgaacatatggagagctcagatttatgtaaactcacctaggaaatatgaatgaatgatgaccattaactctcaccaacacaaaattattttttaaataaaattatgattataaggtattttctgagattcttgtatattaaaatctggcataatggtattggtaatgaaaacaatgtctgaggttctaactgaccataattgcacactctattgtattgctagtgaaccgtttagcagattccattcatcttagaagccttagattgattaaaaaattaatgattgatgacaattaagacttagactctataaaataagatgtaaacatcatgggttgctgattatttcttttttgctatttagaaatgtagaagaatgcttatttaatatatacaagttagattatatcaaacttttctgtgccttttgtttctgtcatatggcattgaaatattgtacagtcctatagtaacactttaggatgttatattatgaaatggaatactgtatattttcaaagacatattgtaatataaatccccaatatctatctgaaatttaagaaaattgttttgagaggaatatcatttgtcttaaggttatatatgtacttaagagtgttaatagtactttgtttagtgtttttaatgaaagatggtgtgttgaaatatgcaggtctagaagctttaaaattagctgtaatataatgtgtttcaaaaaaattaatattgggctgggtgcggtggctcacgcctgtaatcctagcactttgggaggccgaagcaggtggatcacctgaagtcaggagtttgagaccagcctgaccaacatggtgaaactctgtctctactaaaaatacaaaaattagccggatgtggtggcaggtgtgtgtaatcccagctacttggaaggctgaggcaggagaattgctagaacccaggaggcggaggttgcagtgagccgagatcgcaccattgcactccagcctgggggacaggataagactctgtctcaaaaaaaaactaaaaataaaaataaaaataatattcaaatggtctgaaccatgttgaatgtaatagtgtcattgtttggttggaacatgttaaaatgttaagatttttgtcaaggctgcagttgtacatgttgaaactaatgaagaatatggtgattctacagaaaatacagttaaacatttctgtcatgaaccttctatagtcatgtacaatattttggtctggtacactattgactcaagtggaagtagtgattcaacagcttactcttttaagtatgtctttggaatcaggggactgagatgctattcttggaatagagaggcatccattatatggccctcatagcagtcaactattttctgagtaaaatagtgattataagacatttttctgggaattttgcaaattacatcaagattgccaggttaaatgtaagagctagggactaaattttgatgttataatacacaaaagagggatgggttgttcattgccacaatattctagtgacagtaaaccctgacacctctgtttccattctgttttagtagaagaaaaacgtgagcaaattgaaggaaatccagaaaagttttaaagatgagaattactcagaatacacagatagatcaggaaatgaataagacagttcaaaattagtcaatatctgaaagagaggaaagcactagttaaggaaagaaattaatgatttgaaatttatccagaaataataaaaataatatgagaaatatgtgggcattattattagcaaaaactaccttggtaatgaaacttgagtaataaaagagaataatctctcatggaaagataatgcaatttctcttcatttagagaatctgaaactcagcaagctaaaccttcagcagcagtgccaatgtggtaccaaaaggactagataaacagtgagccttagatctagtattcatggttcaataaatactttcaaataagtataatccgttggcatgtgctctttaagatatgcaatgcgttagaattattggcactatttgaattatatacactattgtgtttgtaattttttggttcagttaagttataattagggaactttagatctcttactgtcaagtcaaaattcaggagcattgccggctggttcaaggaacatctgttacattaaattttatgattttcgcatgagttattgctctatctgttgagagtgtcttgtttccctcgaatttaactttaattttaaacatttgtagaaaatgtttacatcacaataaagttgtacataagatttaaacactcataatggaaaatgaattgtgtgttgtcactcatgtctctacatagccaaaagtaatgtaaataatggtacaatttttgactgttatatagcagttttcagaatgcaacttagacttgttttacacatattggaaaaccaagatgaatttttatttcagttaaatactccctggcatcggtgtccaaggcctaagagtgggattggggggtgagggggacgatagattcttcctgattctataataaaatgactcagcagttccctgtgagcttggatgtatacacatatgtttgtgataaatcctctgactatatttcttacatacagagtgaggagcaattgaaacacatcaaaggaatatgtgtccttcatcagcaaaagacaagaaaaaaggatgatggacaattttcattttacttggggcatgaaaatcaagttacttaatttttttttatggaaggagtgtttatactgctcagttttcaaatctcaatcatatattttattatgtctggatatgttacatttcacattaaagctatatgtttagatataaccaaggaggcatcattataaaccatatttctagatgcctttcttccctacttggggtgtcttggatagagctgaagcttattcatgtaaaccattgatgatgccttaagccatacttactcacaaagaagtgtagtgaaaataaaacatcttaaaatatttgtgattgaattgatgggtaatatgaaactgattcattcattggaataaataggaaaagaagttttaatgattcatgagaaaatggaagttaggttcaattgttaaccagaaaaggatgttgtattctcaaataaaggcacgatgataaaggagcctatacattgagagggacagtctttttaaagcaagacactttaacatccatttggtctcttctagaggaagcactctctattaaaacaaagattagaatgattttaagcctatacatgtcaggagaatgagatattttttgacttgttattttggctaacaagtatattttcatttctgtgattcctcatttgcaaactgattaaagtggttttagtacagtgtttcctgtggtcacgtaggactgtcttaggctgactcagaatctatgatccaggcacattgttatcgtagcatttcttaaactgcaaaagtaacagatttccctactgtaataattctgattaacagcgtaagttctgagacaggcctgattctaaatgtcagtcatgacctcttatatcctaatcattacacagttcagtagagaagaaaagtagttgaatttgtactcagacatgtgttaagtacagaagccaccagaggtgaaggtctatccttcagagcagttcaaaagagaaaacatccaagagctctgagcctgcatattacgagggaggcttgacagatgtacaaagaggaactttggctaaatacaattcaggtacagtaaagtataacattacttctcatcactaaaatacaaccaccccatgtcctggaatttgatgcacaaggttaaaaaagcaaaacaaaacaaaactttaaaatgtagaactattttaaagaattatcataaatcagaactctccttcataaaggcctgataatttagagattatcatctatgcaattgtgttgttattcaaagtaaattaactcctggcttatagtacagtattaattttgcatgactggaatcacattagagaccatgttactcctagcaacattactactaacatttacttggtgattttatactaatttacctggatatccttatgagtaaaatgcattgtacaaatacatgtaaagtagaataaactcctatatttgtgaataatttcttccataatgtattagacaaatttcaaatttggatttagaaagcagcttattgaacaatctaattcattttctcttaaacttagtttatcatcaccatatcctgggtcattatcccgtattatattaaaaaaagagttccaggcttcattaccaacctactgaatctgaatctacttagcagaaggggtgtggcatggaatcaaagaggatggaatggaaaatactagaaaattgaaatttgaaataaatcactagattttgatgatttaaatatatagaacattatctagtaaaaaaactcattttatagatacagatattaattaattcatccatgcatatatttactcagcatttcaatgcaaatatgtaattaaaaataattaaaataaaaattagatatcatccctatcggcagagactttataacctaaagtcatgagttatgtaagtatttgcgtgcaacccatgtcaacagagaataaattatcaatgtattgttagtggtatggatagcaagagttgtgatatcatggaaaagatctgaactagatatcatgattgtagctcatgtaatttttctaaaaatcagtatccttgctgataaaacgaatgcactaatttagattatttccaagattctttttagcacaataatcttaaaattatgttatttcagagaagggtgagtgtgaggtggaaggatggtggaattgtgaaaaaataggacttgagactggtagatggataaagtaggagagcgagttgggagaatgcaaagttggtggaaggagaggagtgagttaagacaaaaaactggatggtgaagtatcaagttttactaataatttcaaacatataagcacttgagagacacaggtgaataggagggacctgggactccaaaaggagctcccgaggtccgtcctttcatcaaattcacatttttggcccagagtagtagaagaggttcctctgagaagtgagttacctcacccaaagggagtattttaaattataaaacatttctattgtatgtacaaataattacatagcttatgtgacatttatagggaaccatattccacaaatgtatagaccctagatttgtttcctagaagaaatccagaaatcctaaaccatggaccacctaataaaacatttatatacattaggattcttaattcatttgcttcccgtgagaatgattactagcatgtttactagagggtgagactaggttaacctgctttctttcattctcattagtgtccccagtaataggtagaaaaatagatcatagactagcttccaaagtctttctttcccagggaaaaatgtatatgtttaggaataaacatggtatagcaagatgtcaggatctaatttgaagataaatctctattttaattgtatcaacatttaaaaaattgattggggttaatttctactgatatataactagctgtgcctcactaaagaagaatttaaagtttgaaaatgtaaaatattgtaaaagaaaagagattttatttaaaattgattcttctaactttatttcagaatacatgcttagatggcactttgtgggaacagtcggtagggagaaagaaatgactcaagattatggcacaacttcaggatcaacagaatttgattctgttcagaattttcagattcagaattttctcaacctattagtcccattctgttactgtctatattttgttaaagttaatatgcaaagtaaagcatgagatgtgcatttgttactcattttatcgctattagcttttactactggaaaaagttatcagcagttttgctgggaactgtcatatttctgaatttgatgtaataatttaaaaatatgcctttttatgagatttcaactaaaagacatcctctgtccctttaaatttattttgtggtcaccagaactcacatatcgaactaaagtttacatttgaatttttacttttcacgaattagatttttactaaactgttgcattcttaaaattactttaatgaaagttgtctctataattcatatgtatagacatttatgtattaaaggatatttatgtactaaagctaattcttgtcaacccttatacaaaatgggacttattttaattgtaactaaaagctaattacagatacatatatatatatatatacacacacactttttctaattagcctcacagaaaaatttatcacatagtctgtagggaatgtgtaatgtgctatttaccaaagtgacagcaatcaatctattatgtaattttgattttcataatagtaatttatgaaattaattaaaaaggccaacatgagatgctgcatttaggcatttttttcaattatgacttcatttttttagtataatgatttcaatatatagcctttcaataaatcagacagatgcaagttattcctcttacatctctaaaattggaaaaatatatttgagtatcaatgaaggaaataaaactgtaattttaaattacatccaattctgctaattaagtaattattgaagacaaaataactcatagagaagccctatatattccatatttttccagtctctcctcatttaatattcttatttaattatgaggtatagaatattagaatttcattactggcatctggaagcaaagataagatggttgcaggctttctggtatggcattgtgtgtgacgtgagctgactcacagcataaagggaaatgagagagagtgagtgttccttactgaacttaattgtacataagagctcctctgtagcgttgctttgggggtatctgccatagaactctctgataatgatttctcatcagtggaccaagatgccattaagtcattctccttgttaaaatctgcttattgatgagtttcacttaaaaattaaattcaggtcacttctggacaattgtcttctaatttttttgttctctacataaatggaaaataagtctataatgtttgtcatccaattaaaattttatataatgaagactgtgtttatcaaagacaaagtaactgattcaacttgttcaaaatggaccattcattgaaatgttcaccctagttatatgatgctgtagagacaaaaatatggttgacaatgtttgccttctgaaatctctgaaatgatatgatttagtgcaaatgtctctcaaatgtgtttttcttttagttaaaagtaataatgattaattctgtcatctttctcatttttcctgaggtaataggtattatcaacttgatatacatcttattacaccttattctatgctaataaacatagaaatatgtatagacatatataaaatagaagtgactttaagtttattttacaaaaataaggtcatagtagataagtttgctttctgtttttaaggtaccatgatatccctacaggtcaatagaaataattaaaatattattttaagcagccacatagcatttcataaattgaatgtaatataatttgtgtgatcattctagtgataccaatttgtgttgtttttagatttgttttggctttgctgctataaatatgcttcaataaacacatttccaactggcacacctttttctccaggatagagttccgagaatggagtttctgggtcagaggatgtatgtgttttttaaaaatattactgtattaccttcataaatggctgtagtaatttacatccccaccagtcatatgtgagatttacaatttatgtatgttcttgccattctaaatgctgttaatgattttattttattttcatttttctttttgactaatctgattggttaaaaaatctatcatatctaattattatttatatttgcaattctttgtctgcatgataccttgagcatgtgtttttgctttctttgacatattaggtttccctgtgtctgattttcctgttcttatactttagtttatacttttcttatcaatgtatagatgttcttttatgagacattaatcatgtatctcaagtgtgtgacaaatatttttccctataagcctttgtggtaggggactagctacctctcctacatcatacctttacctctataccccctgcatttacttccagctactctgatttcctgacttaactgtcaaacaagacaagcctttgtattaagtcctcaacctgggaaagctcttccacaagaaatttacatggctcactcatttcattcaagactaaaataacactgttgtaactctctctcctcatttggtgttatttttactcatagaagtagtatttctcattactgtgtattatgtatctcctgtgtgctatcacttatgttatacaatctccatgacaacaggagtgtctattttgtttactttgtgcccccgcacacccaacatttaaaacactgcctagtacacagtaaatacatatttagatttgatgaataaataatttgttttttgtttttattgatgatatcccaatttttaaaaatctaaaaatcactgaaatctctcaaataacttgtattaaaacttctggcctaggactgcattatgtctgtacttttagttagggcatttccctttccaaatctttgtttgtagtaatataggcactactcagtattctcaaatacctatcagtggactcttcattatttactagtccttagtctcacattgtaaagtttttagcaataattagatcttagagctgagcataattaccccactcactgtcctctgaggccatcaccatttacacatctcttactcttaacacttacacactccaatctcaggccctgtgccactgccgaggcgactgctgcttcctacctgttgtaggcagaatcttgttcccccaaattcatatgtcaaagacctaaccccagtacttcaaaaagtaaccattttgaagataagatctctaaataggcgactacattaacatgaggccattagggtgggttctaatttaacctgattagtgtacttataaaaatagaaaatttgggtttacagaaagggacactaaagatgcatgtgtgcggtggaaagaccacatgaggacacagagaaagtggtcatctgcaagccatggagagaggccttgggagaagataaacctgttgacagcttgaatatgaagaatactaggatattaaaaagtcgatgataatagaaaagagaaaaaagtcattgctgatgcccttctccaagaagctgaggaattctatctagctgcagcagccggctttgtaggagcaggtgtgccattaaacacggagagtagaaaggatggtgcaggttagctaaaaacagtccagtgtcaatggcaaagattctgatctagcaggcaaaggagagcatggcagaagaggaagctctgaaagtaggaaagtctaaaattagagacagtgacaaagttatgatgctaggtgatcttcagaattgtgacatgcttcctatgcaggagaataaagtagaaggcttggggaagaaaatctagccaggatgttgggagacctgcccatagactggagtcaggtactagaaagaaatggattttctaggtcaaaaatgtaaaacagaaatcttgttctagaccaagtcatcaaggaaggcagcagattggaaatactgtgactatggaaatatgtgacaatttagaattcattactgcattctggatgttaagctgaagcatctgataaaccttttaatgcaggcacatcttacggaaaaaggtagaattcatctgtgattttagtcacgaagatctgggaaatcctaggcagacatgtttaattctgttctgttcttttatttaaaatcaaaggaggccgggtgtggtggctcatgcctgtaatcctagcactttgggaggctgaggcaggcggatcacttgaggtcaggagttcaagagcagcctggtcaacatggcgaaaccccatgtctattaaaaatacaaaaaaaaaaaaaatagccgggcgtagtggtgcatgcctgtagtcccagttactcaggaggctgaggtgggctgaggtgggagaattacttgaacccgggaggcggaggaggttacactgagccgagatcacgccatagcactccagcctgggtgacagagtgagactccatctcaaaataagtaagtaaatacataaattaattaattaaaaggaactgtctacctgatatgcaaagccccatatggaagtgggaggggagtaaaatcatatcccaattttcttagctagtgtttcctaatccatctttccccatacccaacattgaaacatacatgatgccagctgctaggtgattttcctaagtccagcttccgaattacccttacagccaatgtaagataacagcaactagcaattgtgtagactttttattttttgctaaatttttttttctcattttaaaataaattatagaccacacttagatgtctgccgggtggtggggagcggggggaaagctgttctgtagtttgttgtacaagtgcagggctcctcaaaagaattaaaaagtgagtggcagcgcatacattttggggacttagtgaaaagaagtgcccttcatggtgttgttggaaatgttcctgtattcccaagtgtgccttgattatgaaagcagtgccaaaattaacagacatgttttttagcatctataagctgtatatggtaagtcacagaggagactttcaaagtggccctattgaaagcattggaagagtggcgttttagaataaaatactgttaactactctgattaaattagacatataaatgaagatgtttttcaaaagtgcttcagataatcagatacatttctgaaaaaaacagtctcattctagtaaaagcacaaactactgacacttgaaatagcaaacaatattgtggtttgatctgagaggcatttttatctaatacgttcaaacacatgaagagaaacatcacttattgaaggcctgagacaccatgctcagtctgagttgtaatttgagcatgcatagagaactgcttggatcctagaccctatacgttactcatcttataagcagcctgaaaattgccttatccctgtccttaagacaagtattgtcataggactcaagttcattgacattgattctgcagaatatttctttctctcttgctctctctctctctctgtcttgttctctctttgatctaggtgttacagtttccaataattggtttctagccccttccccaagtgatcaacacttctctttcagccacccttatttctctaacttttgtacccttaatgatttcacagttatatcctcattatcttctcacctaccattatataaactgtattcctaccttgtccttaaattaacatgcacttatgggttttttttagccatgcatgtttaattcttcttataactgaattaatatgtggaccagccttctaggagcctgcattttctgtccctgaaccccagtttatccatgagtctatccccaatatctcctaccaaacctcatcagcatgagtcattgcccatttgtatatctctaagtttcttggtctactctggctgctacagacagcctccttaacattttgttgaccagtcttccagaagctggtcaaatcaacctcttctttcttgtagaatactgttagcctttggtacggtcctttagatttacagaatcagttgtctgtcctaaaataatctactcctgactttatttctctttagagcaggacctcttatcctccccttttccactctgagccatgtatagagaactgcttgtatccttgaccctgtgtgtttctcttgcttccacctgagctctaattaggaaaacttattctgaataaatgacacttggaagaacaaactctgacttacaaagtagcattatacagttttaagtatttttagctaccagctgtgcaagcaataagtaagagactttgaagtgctaaaaatatttgggaagtgtcaagtgggagttggcaaataccctggggtgagaaaagccctagatatgatacatctggcacacatttttagaatgttctatttttagtctgtgttttgatttctgaagagatccaggggtgtttcccttaaaaagaagcaaaagtgacagaaatgcctttagagaacaaggtaatttctgaagtattctttctctcttccctctgcccttcaaattaaaattggcatgatgcctggcattattcttaaatcataaatcactctgaaatctttagaagaaaagtgttctgtaatgtgcaattatgaataagaaaacactgcttgtaacagttaagtatcttgctttttggttacagctctgaggttatcactgccattatttttttcctagttattattattgactaatcattacaaaatcttctagctaattctttttagttggctcatatatgacacttattttggacagtatattcaattgagcccttgtcattgtggctcaataaataaagaatataaccaaaggaaaaataaaatttagtgatgcaagtttgtcttttggttcaagttctaatattaccaatcctcagaatatttcctgatttctagtctcaggaaatacagtaacttgaatacagtatggagctcctagataagctctctttatcatatacagatctcttgctggaagatctcctgtggccatcaatagaaatttaactcccaagcctcctaattagtattaaaaacggggagagagactggggatgggtgtgagtgtgctcatgtattgaattggggtaagaggcaacagagagtccagtcaaaaaatcttagtgaatcttacttttctactatatccctaaggttctgaaaaaaaaaaaattagctcatgggttaagaaatgcctgaaacttacacacttaccagtacaatttgttaattaatagagttttgagttaaaaggtaagtattgattatcagcaagtctttatacagttatcacctctgatttccaataatgccatggattattaaaccttttatttcttgtcagccccatgtcacgtcttgtacagtttgtataaagacacttgatatcccagacttcctcaaggaatctgtcactttctctgtatgttcttaaaattttcagtctcctctagtgatagtattggtttgctgtaaacatttcctgattctgtctgacaagagactgttagtctttgaacaacaacaacaaaaatctctgaaaaataatctgagaaatcctattgcaatactatcattagtgtaatggtgatttaaaaatacgtttaaggtattacaattttgtgatgtcttttcacagagatttagtttataaaaaatccaactcatttgtaaatatcataaactatttgttaatatatttatgtctttacaaccatttcaagtttttaacgactaagcattttttctcgaactttcaaaaaaaatgtatcttaaaaatttagattgtttttaaagaaaggtggttccaaaatgtatgttttggttctattcagtgtaattgtggagtgtccacatagtcttaaatttatatattaaattattttttagataatttgttgagatcattaaacaaatgtttagttttcagaatgcactaggaggtgaattataggtatgggcacctataatattacctatatgctttttagtttctattttgatattgtgttacaaatgtctcaggttttaaatctcctttaaaaactcagcagaaagagaaatttatttgattatgtgttgggatatagttgcaaaaattaaagataatagcaatgttgaaatttggccagtgatctgcattaactgaggagaaatgaaaagtgtttctgtggcatcacaaacagccagctaaacctccaacaatttaaaaggcaacctacttcatcatctttaaagcagagggaaggttggcaagaaatatgcatcagcaatattttctagttgaacaaatatctgaatataattctaggcttatgtttccaaaaaatgtcccagaccatatttaaaaactgcttcaaattatgtctcttaaattatgtttatgattcatatattgaactttcattaccattaaagagacttattggatgtgtatgcatgagtgaattaagacatcgtgttttgtggtagttgataagaaagagaaggagagttaatggcctagaatgctgacgtttcatgggttcttcaagacagcgttcaccagggaaaggaaaacttttgatggcattcatcaaatttgtcagagaaattaagaattataaaatcttcctcttaccaacatgcagaatcatgcaggcgttcctttattttatagatacacctatgataatactgcaagtactaaaataataaagagagctatcaaatgattttttcccctgcaaggaaatgtccttcctgtaatcagtagctattatagcccagccatcgttagccattatattagccttctctttttggtcagtagcttaagaattgaaccataacatttataattcagtagtttctgcacacctgtctactttgtcactggctcaggggattttgatgtgcatgttttgcctcagtgagtcagtttcattgacgttcttgcaaaagttgcatacacagtataaactttcctgagaaagatacttctttgccataaggcttaaaactattcataaaataattctaattttaatctaagtgatctaaatttaagaacaaataccaaagaatcaaatccatagttaattcatgcatgatagataagtaaataattggtatttatatttgaagcaagctcagtgtttcaatgcaaaggttttatgcatctgtctgtaaaattgggattgctgttattgttctctgaattcatgaaggtcagtttaactaaaatgcaaaagttgcttatagcattatttacataaggatacaggtggaatgcaaaggaaggctgcatctgccatcatggaaataagttttatgaatctttaaatactacattagttgtctatgtatatttattttcctcattaagaaaaactgataagggataatggacatatctccttagtgtaatctggcataaacatcttaacggctctgacttcagttttatatttacttgtgttatcatctgattatctgtcttctccctttgattgtatgctccataaaatgagtccagtcagatcttgcttatcattgtattctctgaatctatcaccttgcctggaatctagtaaatgatcaataaatgtctgttgaattaacgagcaaattataagaaaagtgattcaatgttttttttaaaaaacttcaaaacacttgttcacacttgatcaattgaaacttgttaataaaaatacaaaattagactgtgtaatttaatgctagtactattggtgtttcccagaagcaaaagtgtatataggagaggaaaaatgtgttttctgtctgcccttctaagttcttggcagaggcctctgtaaaaaaaaaaagacatattaacaagagaaaagcatataaatgcatctaatgtaggttaatatgacacaggagtcttcataaggaaatgaagaaatgattaaacttgagtgcttttatgctaggcttgatgaagagtggaaagtcacagacaaaatgggtatgagctaagagtattaagctgagggaaacttggcaaggtctgtgcattcagatccctctcagcatccctctgccattgtacataagaatactcatttcctagttcatagcattaaatgactacatcaaaaagtctgaaagagtacagcttagacaacctaatgtcacaccttaaggaaccagagaaacagaacaaactaaatccaaacccagcataagaaaagaaatcacaaagatcagagcaaaaataaatgaaattgaaacaaaaaaaatacaaaagataaatgaaacaaaaagctgattctttgaaaagataaacaaaattcattgaccattagtgagattaaccaagaaaagaagacagatgatccaaatgagctcaattaaaaatgaaactggagattttaaaaccaacaccatagaaattccaaagatcattcaaggctactgtgaacacctttatgcacacaaactaaaaaatctagaggagatgggtaaattcctgaaaatatacaggctcctagattaaatcaggaagaactagagacactaagcagaccaataacaagcagcgagattgaatcagtaataataataaaaaatgcccacaaaaagtccagaactagatggattcacagatgaattctatcagacattcaagaagaattctttgaattcttcttttcaaattctcaaagaagaattggtaacattcctactgaaatgattccaaaagataaacgattccaaaagataaagagggaatcctccctaaatttttatatgaatctagtatcaccctaataccaaaaccatgaaagcacataacaacaacaaaaattacagaccaatatccctgatggacatagatgcaaaaattcccaacaaaatattagctaaccaaatccaacagaatatcaaaaatataatacaccatgatcaagtgggttttataccagggatgcagggatggcttaatatatacatgacaataaatgtgatatgtcacataaagagaattaaaaacaaaaaccacatgattatctcaatagatgcagaaaaagcatttgataaaatttaatatccctttataataaaaaacctcaaccaaatagacatagtagaaacttatctcaaagtaataaaagacatatatgacaaaccaacatcatattgaatcaggaaaagttgaaagcatttcccctgagaactggaacaagacaaggatgcacactttaaccacttctattgaacctagtactggaagtcataggcagcgcaatcaaacaagagaaagaaacaaagggcatccaaatttgaaaagaggaaatgaaactgtcgctaatcaccaatgatatgattgtatacctagaaaactctaaagtttcgttcaaaaagctcctatatctgataaattcagtaaagtctcaagatacaaaatcaacgtacgtgaatcagtagcactgctttacaccaacagtgaccaagctgagtatcaaatcatgaactcaatccattttgcaacagctgcaaaaaacaaacaaggagttgaaagatctttacgatgaaaactacaaaccactgctgaaagaaatcatagatgacacaaacaaacaaaaacacatcccattctcatggatgagtagaatcaatattgtgaaaatgaccatactgccaaaatcaacctacaaataaaatgcaattcccatcaaaataccatcatcattcttcacagaactggaaaaacaatcgtaaaatttgtattaaaccaaaaaaaaaaaaaaagcccacatagccaaagcaatactaaggagaaagaacaaatttggaggcatcacattacccaacttcaaactatactacatggctatagttaccaaaacgacatggtactggtataaaaatagacatgtagaccaataggacagaatagagaacccaaaaataaagccaaatagagccaactgatcttcaacaaagcatacaaaaacataaattggggaaaggataatctattcaataaatggggctggaaaactgacaagccacatgtagataaatataaatggttcctcatctctcactttttacaaaaatcagctcaatatggatcaaagacctgaagtcaaaaattctagaagataatttcagagaaactcttctacacatggacttaggcaaaggattcattcctaagactccaaaagcaaatgcaacaaaaacaaaaatgaataaatggtacttaataaaatgaaaaactttctgcacagcaaaagaaataatcagcagggtaaacagacaacccacagaatgggagaaaacattcacaaactgtgagtccaacaaaggaataatatccagaatctacaaggaactcaaatcggcaagaaaaaaataatcccatcaaacagaaggcaaatgatatgaatagacaattctcaagaaaggataaacaaccaacaaacataagaaaaaacatgctaaacattaccaattattagggaggtgcaaattaaaaccacaatgagataccaccttactcctgcaaaagtggtaacaattaaaaagtaaaaaaccgatagatgttggtgtcgatgtgttgaaaagtgaacacctttacattcctggtgggaatgtaaactatgaaaaacactgtgacaattccttaaagactaaacgtagaactaccattcaatccagcgatcccactactgggtatctacccagaggaaaatatattgttatacaaaaagacacatgcacatgcatgtttatagcagcacaattcataattgcaaagacatggaaccaagctaagtacccatcaaacagagtgggtaaagaaaaggttatatatatagatatatgtgtgtgtgtgtatatatatatacacacacacatacacacatacacataccatggaatactattcagccataaaaaggaacaaaagaatgtcttttgcagcaacttggatggattggaggccattattctaggtggagtaattcagaaatggaaaaccaaatatcatatgttctcacttataagtgagagctaagctatgaggatgtgaaggcataagaatgatacaatgtatatagctcaggtgacaggtgcaccagaatctcagaaatcaccactaaagaacttactcatgtaaccaaaaactacctctactcaaaaaactattgaagtaaaagtaattaaaaaaaaaaaaaaaaagaatacaccttttctggccagccatagtggctcacagctgcaatcttagcactttgggaggctgaggtgagaggatcacttgagggtaggaatttgagaccagcatgggcaacatggtgagacctcactctatttattttttattaatttttttttaataaaaagaatgctccttactttcaagtgtagggtgggcaccttccacattagggtcagaaagtctttcctgcacatgctgtttctcaaattccttcagctaaaaatactcaatgtccaagatgccatattttgagtagtctctctaaaatcctatcaaggagaaaattaaatatatgtatttattctaattcctcatttgcttagtaggtgccataagttttcaggaaaattactaaaaaaatttttttatcctatttggaagtctgttcaactactaatgacagttacaggactgaacctccttagaatctcttcttttctctgcttcttttcttgtttccttttctttcttttttcttttctcttcctttccttcttttctctttccttctcttcattctttcatctttctgttttccgatttttctttttctctctttctccctcccttcctccatttctttttttcttcctcctgcccaccctccctcttccctctctttcttccttcctttcctttccccttctctctccttccttccttcatctttcttcctttttttttttaaaaaaaataacatatgcctgtggtcctagaatactattgctgaaatgtccttggaaagcactttaagaataaaaaagttaaaagcaatgatgttcccagcattacactatcattttaatgtcagaataaaaacttggaaatagctagtgattcctaatttaaagatatctttattatgtagggaagtttatgtagaggaactttccctctgaggtttcaataacagagtcaccctgccaaattaaactgacaatagacagatgatcaaagcaaaaggcatagcaatttattaagatgcatataaacatgggagtcctgcaaatctaagacttgaagggccagatagctgaagcttaaataacctcttcatagcgaagagggaaatgggggatgtaggcaattgagaggggtagtaaatgacctttaggagaaatcaatgggcccaggagacagaaattagcttgtaaatgattctctttggaatatgagtgacactgaaagagacaatgtcttgtgacaaagtgtgtctaggtgttggttacattcttcaatcttccttcttgtgttagataatgaaatttcagggagggaatagaaggaaattgcgttccttcaggaagagcttcagataagggaacttcataaatagagttctaccttatgcttggtgggaagaaacaggagaaggtcaaaaagtccttggtgctgaggctgtttctaaggtcttttaatttccttgagttcaaaagtgctcagcatgccgaagcaccatactgtggagcgttgctctcttgagcttcaacaattacatttaagctagactgaaaaatatagccacaaagtattaataaataaaatagatataatgagaacaatgtatttaaagacatggatataaagatatattggataattctagcaaaatagcagattaggctgttggaaataggcctgctttctgccccaaacacataaatgctttgaaaaaactatgagaatagcaaaaaaaaaaaaaaaaaagtattattgctctccacataactgaatttgacagaaagaaagatttcccaggggtgaaaaacaaataatgaaaaagaaaatgacaggggaaggccaaatctctgatagtccgctggcattctggcattagataccggcaacaggactgtaggctgcagtccctaatgcccatttatagataaagaaatacttcatctcaaacaatggactagaatttaggcctctacatcaaataaagagcctaagcttattctttgctctgaataggaaaaatctatccatcgacctgcaaaatattagggaagctatttaatctagggatttgagtcagtgtgagggagaatcactgacaagcatcaaaaccccagcttccctataaatgaatgaaagttttgaagttatgttaaccatagaacacagtaatctacaggatgagaaatgatataaaaatagagtcggggtaactgatgctatttgagctctaggcaaaagcaagtttcataaataaataatctaatttcttgtaagatatccaaaagaaaaaaaatgaattagaagcaaaagtcaatgacatagtggcaaacaatgttttcagaaaagaaaaatcaatatgtgtgcacctttcatattgaagggtcacagtgagtcccaaataggatagtccaaagccctacccaagtttaactgcagcatgttaaaacaaagaaaaaactttacatctttgagagagagagattgagagaggtatgtagacaaaaagaattgaactgtgtaaaatattggaagagatttattctgagccaaatatgggtgaccgtgggctgtgacagccctcaggaggtcctgggaacatgtgcccaaggtggtaggggcgcagattggttttatacattttagagagcatgagacatcagtcaaatacacttaagaaatatattggtttggtccagaaaggtgggccaactcaaagcagggttggaagtggggagggggaggtttccaggctataggtgaatttaaacattttctggttgacaattggttgagtttgtctaaagatctaggattgatagaaagggaatgttcaggttaagataaaagattgtgcagaccaaagttcttttgaagtcttataatggctgcccttagagaaaatagatgacaagtgtttcctattcagatcttagttaatctctttaggattgggagggtctggaagaaaaagatctagctatgttaatagagcttcttttatagatgcatgttcttccccacaaagaacaactttgcggggctatttcaaaatacggcaaataaacatgttttggggtaaaatatttttattttcttccttgtctggtaatgttataccagagtcaggttggaaaatcatgatatatagggttaaataaaagccatctgatgagaatgtatgatttgtagggcatgactccccagtctctttagataggaatttgggcaagattaaaaaatcagtttagtcctcaggtatatactggctttctaaaaaatgaatgatggttagagcaaaagtggaagtctcatcagcaaaacaggaggaaaagtagaaagtactgagataaaataaccaactcagaacaatacccagcaaattaacaagaataaaactgaagtgaatatatagcaagcccaagaaaggaaaaaacaagacttaagaatctatcattcaaaaatcctcactgacagaaaaaccaccggaattatttcagaaagaagttaattaaaccttaaggaacaagtttgtttctagaaaaaaatagacaaaaattttgattaacctaaggaattcttgtcactaagttcaatattactgttaaatatactgactagttttgagtgtctaaaacaagaggaattaaatagtagacaatagtaaagtagaaagatagaatgaggaagattgaaaataaaagtgttctattttctgttgtctaagaaatgtacagttgttccttggtatccattggggattgttttcaggaacccccctgggataccaaaatttatagatgttcaaattctgtatatcaaatgcactgtatttgcatatgacctgtgtgcatcctcctttacattttaaatcaactctagattacatataatacccaatcaaatataaatattatataaatagttattgtgctctatggctttttacactgtatttttgttgttgtaatgttaatatttatttttaatatttttaatctgtgtttggttgaatccacagacagaatccacaaatatggagggccaactgtatgaaaatattgtttttatttttagtttagtttgttaaatcaagcttacttgtcaaaagaggaataaagaaaccaattaaaaagtaataataaataaaagccaccaaccattgtgttggaaatgaatctatcatgtcattccaatgaattacaatgaatataaacaaattctcccattaaaagccacagtcgtgcactagattagaaataataaatccacaaatacactatttaaaacatgatgcagaaaagataaaaataaaaagattgaaaaagatataataggaaaacgataatccaaataaagttgttaaagctgtagtgatctaataaaaaaaaaaagcttgaaagcaaaagacattgctaaagtgggtcagtatgaaataatagacagcacatttcatcaggaacatacaccactcctgaatgtattttgcattataatcccaaaatacatgataaagatgtacaagaattataagtttagattgataagtctacagtcagaggggaagatactattgtacttctttcagaaactatcttatcaaacagacaaaagtaataatatggaaaattaaaaacacaattaaaaaatcttaaattaattcatgtatttgaaagaactctttattctttttaagtgttctcacaaattaattatgtacttattcataaataccaaaggatgaactaaatatactcagatctaaatgtaataaaattagaaaaaaattatgaggagagcaatcagatacattcaaacactgagaaacatacttccaagtaatccaagaatcaaataaaaaagtataatggcaattattaaatgtttaaatcttcaaaataataaaaccaaaacttaaggaagacaagctaattttatggaaaaaaattatatggtcttaaatgagatttttataaaggagtaagaataaaaattagataagtattcaactaaagaaattcaaaaggccaaagttaaccttaataaataatacatacataagctaaaagcagaaattaatagaaacaaatgattaaaaatagaatggccaggtgtggtggctcacgcctataaccctaacagtttgaggacgaggcaggaggattgcttgagtccaggagcttgagatcagcctggacaacatagcaagacagtgtctctacaaaacttaaaagattagctgggcatggtggtgtgcacttgtggtcccagctactctggagggtaaggtgagaggattgcttgagctagggaggtagagctgcagtgagccatgatcatgcaactgcatgccagcctgggcaacaaagtgggaccctatttaaaataataataataataataataataataataataataatagaatgtatctcaagacaatgagaagaaaacctacatactgggagaaaatatttacaaaagacaatctgataaagaactgttatctaaaataatgtgatgaagtcttaaaattcaacaataagaaaataacctgattaaaaattgggtttaaaaaaatgaacagacatctcaccaaataagatattcagagggcaaataagcatatgaaaagatgcttaacatcatgttattagggaattgcaaattaaaataactaacagctatttaatattattatagcaaaaatgtaaattactgacaacataaaaagtggccaaaaatgtggagcaatagaatctctcattctttgctagtgggactccaaaatggtacaatgactttaggaaacaatttggcagtttcttataaaactaagtgtgctcttaccatacagtctatcagttggactccttggtatttacccagaggagatgaaaacatatgtctgcacaaaatcctgcacacagatatttatagcagctttattcataattgctaaaacttggaagtaaccaagatgtccttcgttgagtggataaataaactgtaatgcatttagataagggaatattattcagtgctaaaagaaaatgaactatcaagcaataaaaagacgtggtggaaatttaactgtatattactaaataaaagaagccaatttgaaaagacaacatgttgtataattccaactatatgaccttctggaaaaggaaaaattatggagacagtaaaaaagatcagtggttgttagggattaggaggagaaagagatgaacagacagagcacagatgatttttaagacagtggatctattttgtataatatataatggtaggtacatgtcattatacattcgtcaaaatccacaaaatatacaataccaggaatgaaccctaatataaattgtggactttagaagataatgttgtgtggatgaaggttgttcttggtcctttggctagagaggaccaagatctttgatgtggctttttgtggttgtgcccattgacatttctgggttgtcaacttaaatttaagtatatataaggcaaaaggaaatccaaggtaacttatcctcatgtcattccttgggccctgaagtcccttagagtttccttatgtttattttatagacaatatctaaggtttttagttgtgcctagatgaaggaagctcttccgttttctctgaaacagaaattcagtttcccactttgccaagaaaattaaaataatcctaagaaaatctacaaactcccatgaaatatgtatctactcatagttatctgtattaatatagtcttatctcatatcctagactctctatggtcttgtataaaaaaatccccaaattcatcaagattttgaaaggatctatgtgcttctacctcctcattagactacattcatctttttcattgtgccatcgcaggcaacattctgtcatacaattggtgcttagtaaattgtgacaaaaattaacaaatagtgctattatagttttcataatatgtataagaacatttaagtttccttttaattttatgagttgactttatatgtataaatgaggagagtgaatgaaatagagattgaagtagagtggaatagagtgaagggagattatgttttggtataaaagatatttgagtgagtgtgtgtgtgtgtgtgtgtgtgtgtgtgttttgcattgaattatcgtaaggtctttgttctgttcactgatatatcttttaagcttgaaaaaaaaaagcctggcatattctaggtgcttgattgatcatcttgaatgaatgcatgaataaacagtgatgtattacacttaaaaaaaaccaatggtatttaggttagaccacgtgttaccatcaaatgaaaatataaagtcttttctagtcttgggaccttatatattatgtgtgttggttcttcttggcatttatttcttaaacatttccattctcctttaagtgattttatcactgcctcttttatattcaccactgagtatcttatggcactgaatatagcagacctcatttataggagcaatattaacctgtattgatttgcagtcatgtaacatttaaatgcaaaaaggtttattaatggcattctttcccaaagaacagaaaaacagttgcatgcttaaatgtatgggtgtgacttgtcatgcatgctgatgtattctaccattgttatgcttgccagctgcaaaccacaatcagaaaacccctagtaattataatagaacaaattaaaaagaggaaaatcttctttctctctgcttagctttcgtgaatacgggaagtcaaaaataaaaatcaggacttagtaaatttttgttgttacagaaaaggtatttctctattttatgtattaataattgaagttggaaacagtttccactggagcttgttacacagcagcagccctttcacccatctccaggccttgaaagtagtggtatgtaaactacaggagtatgattaccagcataggtattgggggaaatgcaccacaatatcctttccatatgatagattctatttggacttttctgttagcaagcacttgcttacattgtagtatttttctttgtaatttccaattatgtaaaatctcaagccatacagcagtaaattaaatttgtaataaaaagttttgagtttaacttcctctgacctggagtcttcacttttgtagagaagcaaaagtatagcctttgttttcttgcttagtttagtttattgagataatacaaagtaaaactcatcctttatagagtacatttcaatgagttctgataaatataaacaatgtgactaccactacaatgaagatatgcaacattctcattaccccaaagagttgccttgtggctctgtgttttcaatctcctccccaaagttagcccctggaaaacacagatctgatttctgcacctataactttgaattttctagaatgttatataaatgggagccacattttcttttaaaagaaaatttaaagggctgtgtacctttctgtatttgtcttccgtcacttagcatatgcttttcatattcattcatttcatcgtatgtatcagttcctttttataactgaatagtattgcaatgcgtggctgtataaaaatttatccatttacagtttgttagacatttaggttattttcagtttgtgatcattatgcataaaagtgctataaatatttacaaataaatttgtgtgtagaaatatattttcctttatgttgaataaaaatccaggagatatttatgggattttggtgagtaaatgtttaacattgtactggtatctcagagtgttttccaaagtggctatatcatgttgcactcccaccagtagtctgtgagagtttaggttattccatatcgttgttaggacttggaattgccattaaaaaattaatttttgccattgtaaaaagtatgtaaaggtatcacagtgcaatttttgtttgcattttctaatgactaatgatactgaatataatttatttgtttcacttttgtatttttgtttataaagtgttcaaatattttgcttatttttattgtattttaaaattttataattattgagttgcaaggttaatatttgcattctggatgcaagttttatcatacacacatacatatgtagccatgggttctgcatctggagatttaaccaactgcagatggaaaatattcagaaaaaaacactaaaaaataataatacaacaataaaacagataaaaatacaaaaatattataacaactatttacatagtatttacatagtattaggtaataaaagtaaccagagtcatttaaaatatacaaaaggatgtgtattagttatatgcaaatataggttgagcatccctaattttaattcaaaaactggaaatctgaaatactccaaaatccaaaactttttgagtgctgacagactcaagtagaaaattctataattagtacttaacacaaaatttgtttcatgcacgaaagtattaaatatattgtataaaattacctttgggctatgtgtgtaatgtatatataaaacataaaagatggggttgtttttttcttgtaaatttgtttaagttccttgtgggttctggatattagccctttgttagatggatagattgcaaaaattttctcccattctgtaggttacatgttcactctgatgatagtttcttttcctttgtggaagctctttagtttaattagatcccatttctcaattttgacttctgttgccattgctttggtgttttagtcatgaagtctttgcacatgtctatgtcctgaatggtattgcctaggtttccttctagggtttttatggctttaggtattacgtttaagtctttaatccatcttgagttaatttttgtataaggtgtaaggaaggggtccagtttcagttttctgtagatggctagccagttttcccaacaccattttttaaataagggatcctttccctattgcttgtttttgtcaggtttgtcaaagatcagttagttgtagatgtgtggcgttatttctcaggactctgttctttttccattggtctatatatctgttttggtaccagtaccatgctgttttgtttactgtagccttgcagtatactttgaagtcaggtagcatgattcctccagctttgttctttttgctgaggattgccttggctatatgggctctgttttggttccatatgaaatttaaagtagttttttctaattctgtgaagaaagtcaatggtagcttgatggggttagcattaaatctataaattactttgggccatatggccattttcatgatattgattcttcctatacatcagcatggaatatttttccatttgtttgtgtcctctcatttccttgagcagtggtttgtagttctccttgaagagatccttcacatcccttgtaagttgtattcctaggttattttattctctttgtagcaattgtgaatgggagttcactcatgatttggctctccgtttgtctattattggtgtataggaatgcttgtgatttttgcacattgattttgtatcctgagactttgctgaagttgcttatccacttaaggagattttgggctgagatgacagggttttctaaatatgcaatcatgacatctgcaaacagagactatttgacttcctctcttcctatgtgaatacactttatttctttctcttgccttatttccctggctagaacttccaatgctatgttgaataggagtggtgaaagagagcatccttgtcctgtgccggttttcaaagggaatgtccacttttgcccattcagtatcatattggctgtgggtttgtcataaatagctcttattattttgagatacattccatcgatacctagtttattgagagtttttttttttagcatgaaagggtgttgaattttatcgaaggccttttctgcatctatttagataattatgtggtttttgtcattggttctgtttatgtgatgcattacatttattgatttgtgtatgttgaaccagccttgcatcccagggatgaagccgacttgattgtggtggataagctttttgatgtgctgatggattctgtttgccagtattttattgaggtttattgcgtcgatgttcatcagggatattgggctgaaattttcttttttttttttttttgttttatctctgctaggttttggtatcaggatgatgctggcctcataaaatgagttaggaaggagtccctctttttctattctttggaatagtttcagaaggaatggtaccatttcctctttgtatctctggtagaattaggctgtgaatccatctgttcctgtgctttttttgattggtaggctattaattactgcctcaatttcagaacttgttattggtctcttcagggatttgattcttcctggtttagtcttgggatggtgtcaaaaagtgggcaagagatatgaacggacacttctcaaaagaagacatttatgtggccaataaacatacgaaaaaaaagctcatcatcacttgtcattagagaaatgcaaatcaaaaccataatgagataccatctcacgccagttagaagggtggtaattaaaaagtcaggaagcaacagatgctggagaggatatagagaattaggaatgcttttacactttttttgggagtgtaaattagttaaaccattgtggaagacagtgtggcaattcctcaaggatctagaaccagaaataccatttgacccagcaatcccattactgggtatatacccaaaacattataaatcattctactataaagacacatgcacacatttgtttattgcagcactgttcacaatagcaaagacttggaaccaacccaaatgctcatcagtgatagaccggatagagaaaatgtggcatatatacaacatggaatacccagcagccattaaaaaggatgaattcatgtcttttgcagggacatggatgaagctggaaaccatggttctcagcagactaacacaggaacagaaaatgaaacactgcatgttctcactcataagtgggagttgaacaatgagaacacgtggacacagggaggggaacatcaaacaccagggcctgtcaggtggtggggggctaggggaagggaggggtagcattaggagacatacctaatgtagatgacaggttgatgggtgcagcaaaccaccatggcacgtgtatacctacctaacaaacctgcatgttctgtatatgtatcacagaacttaaagtatatataaaaaagaaaaaaaaacttaaaagaattttgtgtttagacttgggttccatccccaataaatctcactatgtatatgaaaatattcaaaaatccaaaagaaatctaaaatcccaaacaattctggtcccaagcatttcagataaggagtacccaatctacactgtgccatttcacataagcaacttaagcatctgtggattttggtatccacaggggtcatgcaaccaattctcaaggatactgaggaacaattgtatatgttttcacacattttatctctttgtaaattgtgttgtaattttcttaataatatctgtagtgtgctacaagtgatatttcatggttataaaattagtgatagacaaaatatctaattaagtgtcttgcaaggacaatactacctgctacttaatggtagatggtaaaagggcccaggagactttccagatctccttgataaccggagatggggacttcccagagaccccaccaggatgggattttaagaccctcatagcaaacatgcctgggtattactgggtctctatgataatgagtcctaaaaaaccctagttgttctagagacaaggtcgcctcagcacagaaacaaccttcgtgtactagccacccatccatttttttttttttttttttttttttgagatgagggtctctcttgtcaaggctggagtgcagcggtatgatcatgggccatcgcagcctcaacctccaaggctatgaactttaaaacaaagcttacccttccaagaatagcttaaagtccctttatgaaagaaatacctggtaactgacctagatttaatgccagtataagaagaggagaagaatcccccaaactctgagaatagcctccaaacagagatcctccctgactgaccccctgcctgtacctggcccatgccaccagcctgctcctgctgtccatctgataagagccctgcctaaatagacctcttgagcattagctggtgtctaagactcatctttcatgtgtaatggatggaagaagagaagtcaccccagggaagctggtcaactaggacaactggggaccaccgaagtgacattatctttacaaaaaggagaggtggtttttgttgttgttgctatttctaatgttgatggagtcctatttaccaatttatattttaggtttgtgctttttgagtcctgtttaggaaatatttttctagtccgcgatcacagaagttttatcttaacttctctagagtttcagatttagattttacattttgatctctgaccattttattttttaaaattaattttgtatgtgattacttttgtatactatgtgaagtatgagttgagaaagcgttggtgtgttttttttttaaattaacgtcatacatattttgattttttttggattgttctattctgttctgttaatctttacaactacttttccactaataccagagataaggtaatatgatcatggcgtgtaagtcatccaatcttgttctttttcaaaattgttttggtgattctagtccaaggtttctcaacccttgggacaattgaccatttgcgcttgataattatttgctatgggagggctgcctgggacactttagaatgtttagcagcatccctggcctctactcactggatgctaatagcatctttcccaattgtgatcaccaaaaatgtctccagacaatgccaaaaatcccctgggagacaaagctgtcctctgattgagaaccattattccagttctttgctatttcatttacattctagaattggcttgaaaatgtggcaaagaactgacataactttagtaacttttctaatccttgtatgtggcatatcttccatttacttaggtttttaatttcctttagcagggttttatagtttttatcatatagaaattgcagctctattgaccaatttatctaaaaataccttatatatttgatactattataaatggtgctttaaaatttactttctgattgttgtttgtaatacagtcatgtgctgcgtaaagatgttttcatcaaccacatatatgaaaatggtcctttaaggttataatatggtatttttactgttccttatgtttagatacataaatatttaccattatgctacaattgcctgcagtattcagtacagtaacatgctgtacaggtttgtagcctaggagcggtaggctatatcatgtaaagtatagtaggttatatcatctagatttgtgtcagtacacactatcatgttcacacaatggcaagtttgcctaacaatgcgtttctcagaatgtatacctgttattaagcaatgcatgacttatatagacatgcaatttatttttgtatgttaaccatatatcctgcaaccttgctaaactctcctgttagacctggtaaatctctgatagataccttaggattttctacttggacaatcatgtcataagtgaataaagatattttttctccaatgaaaagatttacgttgttatctgcagcagtagaaatatttccatgttgtttgtttaatttttatctatttatctatctaaattgtttatcagtttaattgcactgtaattaatttaattagattgtctatttatgtaactaaactgtctctgccattaagtagttttcagtaaggcatttcaaaaaatagatgattcaataagaaagctaactagagtctgttttaagttagaggtttagcatattttctaattatttactatctcattcttgcattgagagataacagtcacataaattttgaattcatgaaaacagattatttatttccttccagtggctgatatagactgtacctctgtagaacatataagacttaatgcccattttcttctatttttaagcctctgtgctattttgtaagtctttgtatacaaacagaagttcagtcaaagaagtaagaggatcatattatatacgtatagaaaatatgttttttttttctctttatgcctttgcaggttttaagaaattgctacccatatttgaattcttacatttggtataaggatcaaattagattatgtatataaaatcctattttaagctgtaaaatgagaggcaaatgctagctagatatggcttacgcatgcagtaaatactccatatatagtttttgaattgctagtccttttcagatatacagaaaatttccattgaaccttaaaagcctcaagaagaaagagaagtgagctaattttttttttttggctcagcttttactctagttactggtacataacgtacctctgaaaatattactaagcaattaggacagagttgttttatgagattgacagtgttcttttaaatgccacctatccagtgcacatagttgaatttttctactttgcaggaatttgtgcaatttctccaaataagaaatatttggaggactctagcatggcagaaaacctcagtgggtctgaattgtctaggaccatacatcggaaggatgatgcttcttttctatgttagtgcttagtctctgctattccacatttaatgctttctctgtctccttaaaaacatttccaaataaaaaattaaagaaaatctgataggtatgcacttgcagacattgcttcaacattttgtattaatatagaaccattggtcagtaattatgctgaatatgatttagaatagaaactgaatttgaatcttacctgttacctgtacatttcttcttcaaaggaaaatatattttgtgtacatacacacacatgcgcgtgcgcacgcgcacgcacatatataatgtctattatttctgtaattgattctgcaatgatagcaataatatattttatttgataatatctccaaaaaacgttgaaagttttaagatgtacttactttctgttgcaaaaattacttttacattcaagaagttcaacatctttattacaaaaggtttctgggaaaaatatagatttctataaactatatatacatggacacaggagattggtttatggagatgagcaaaatgaccatcagacactcaccaattgcactgaactcaaactttaaaacaaaacaaaacccattaatatgcaaatgtaggcaactcctgcattctttaacatatttctgaataacttctaaaaggataagtttttcttcaataaatgatgaaacttcaagtttaaaatatataaacactaaaaaaattgatttcatatccaagggtgaatttctctttatttatatctgtatccagctggtagtgggtggtatctcattcctggaaattcatgtattggaaaggaaatgcttaagagaatattcatttagctacaaagcaatggcatttcaagctctgaaatgtcatttggaggagtccctgattccatgggggagaaatgtggctgttctttggcagacttggtaaagctcacttctcagattgatgggtctcgtaaagtcctattggctttgttgactgagctgtacatatcagtatgatttgactgggcttgtgccatattcacattgtgagaattattgtcattagtatcattaatatgcatgcattctccttgttgttctttggatctgtctgaaatttttagagaaatagaatactggcgaggcctcaaactgatgactgtgtgcatttttattttaaaaataaaagcaatttattaataaccatgcatgggaccaaggtggataactaggaaaaccatgttacaattatgtggttcataacaaaatcatttttatgtgcaaatttgatttgtgttattttttgtcttatctgttaaaatatcttttatgttttagtactttgatatagctgattatagtgatgtagtcaggcttttataaatctaatattaatgcaggttacagaaggggaaagaccttccttttattgattgatttttaacagcttttgttcttaatgatcaaaataaaagagttcatgccagaaaacttggaaagtactagagcaagaaactccaaacaaaagacaccgtaatctataattcccatagatgcctttgatattttgatctgtttgtctttcccagcttagggaacactgtggcaaaaaagttgggtttctaaagaataaaaacactcacactcttcctcgatttttgttgggctgagtccacctcacacattgaatggatacatggaagagtggcaactacagtaagaatactgatcacatggtacctgattgatttgcaagtgttacttctgggtacaggcagtgggaggaatcctgttaacctattatataaaaagactagcattggtataggaattcgaagtgtttcctaccgctgtagaccaactcttacctggtgtcaggattgagttatttgtctggtccactagactcagagcttctcctaattttttatttcctttatgtttgttcttctcttgaaacttatggagacctaaaggccctatgtgattcgattccagtattccactccaaatttatgtactttcattctccagtttgctcaatcagatacagtgatacattccttctttctgatttgctctgaaacatgtcaaactcattccttgttcagagatcttaggctgtattaacataatctggaatgtccatttccctgctctaatgtcactttctcagatagacctcccttcactactctctctaaataaccctccagttaacacctatctttttgtttgaccccatttaaaaaatagaacacattatttaaaattgctttgaggtttttatttatgtatttattgtctgtcttgattttctgtcacgttcccccaacctccgagcactgtgatattagaattgaggttgtttattttgtacatctttgtatcttcattgtttagataattttagcacagaggcaatgcctaataagtaaatactgaatgaatgttggataatagagcttggttatctgtttgcatgaatgtgattattagataagttccagatcatagaatcttaagattcttctttatactcactcaagacaaagaggacctagtctcccaaaacaaaaaggttgtctaccttccccatagaaaataaggaggattttcattccttcataatataaatatatgtttaatactacacataatttttattgattgcattctattatatggatataaaatatttttaatcactaacattttactgttgatcattttattttcttccagttgttctgtattatgaatgtcacctctgtggatatttttgtccacatatttgtgtaaaactctgattatttccatagactacatttgttgaaatgaaattgctatattaaaatgtatgcccctctttcagtattttccatactaccatttgaaagtttgactgattaaatacttatggtttaaacactcataaggaaaaatagatattttcagaaaagtttgaaattcttggatacaattttttgagttttcagttttttttaatttaactgcattgttaaagtgaataaagattgacttttttttccaaagtgagaatcagagaaaactaatttgtctgtctcactctatagccattttagccaaaataggaatgtgaattgtttcaaattgtcattctttcttacttctgtttactgttactcttaaaataattgagggtaaccgaaaaataaggcttgaaacacatcagcaagagattgtattcatattgctcattgttttaatgaatagaatcctttaagctaactttgagggatgtgtatctcttttcttaaaagttaaatgttacgttttatctcacaaagatgtcaattagcatgctataagagaaactctttctaaaacatgccccccccccaccacgggtggcatgagcagatatttaatgcacctgctgccttgcaaaaatatcaatcacattgtactccaaaaatgtccaagtaaaaaaggggcaacatttaaaatgtgtggttttggggtcacctgttaaggtatctttagtttcctttcctagaaaaatgattttcttcactgataatatttcagctttgcttttaagaaaagttaatgggtgaaaggatggagtttaaattcttaacagtgggtaattcacttattttcactatttggttttacaatttgaaaaatgagcatattttagaagacacttccccaagataagaattacgtgagtctgacaggaattattaagtatagcgagggaagattggagaacaaagtcattttgaatacatcttagaaaaggagatttttgggcagttgcggctcacggttataatcctagctcttagggtggctgaggcgggaggatctcttgagctcaggagtttaaaccagcatgggcaatatcgtgagcccttgtctctatttaaaaaaaaaaaaaaggaaaaaaaagtttttttctttttaaaataactatgtggtaaatactttttgaatgagtttacataactacctgatgcaatatattttccatgaggagcctcatatttctgagtcctcaatagaaaaaatgagtttttaaaggatattccatataaacaagtatgttgctttttactataaagagtagctaaaatttctccttaagaaaagtattattttatctacatgagaggctttaatgtctttttggagctgaatattatccagaagccctcaaatttatagaacaaatgtgaagaatattaagaattctatctagctggaaaagcaagcctttgtcttaggaacctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaacaagaattcgtaagatgccatcatcccattgacacaactttttttaaattccttatggctctttttcctgttcttatgagaaaatagtgagatgttcattacttttctggactaccatagaaagtacaaagccctgagtttatttgaagtctcacacttagtacaattctgaagtttcagtgtctaatttctgacaataatccaaagtcatatgataaaggttgcatagtcattcctcctataggggatatatagggattcccgaagtggcagaagtcaccttctccctgactgccaactgcagatagtgaagaaaagtgttcaagacagtttcttagtgaaactctctgggcctcatgaaaatatgaaaaatagtaaacacaaatatgtaaatacatatatatgaaaatatatcagatataaatataaaatctttagagatatttaaaatactcaagttggacaacatgttgactacagttgacaatatattgtattattgaaagatgttaagaaagtggatgtaaagcattcttacaacataaatgataattatgtgaggtaaagcatgtatcagttagatttagtcattccactaatgtacatatactttaaaacatcatgtggtacatgataaatatatataattttatctggcccttagaaaaataattttaaaaaatcaatattgatagtttatctcatgttatagtctgtttgaaatctgaagttaaatcatatttactatgaacaaaaggtttaaaaattaaaattcaagctgattctttaaattttaaaattatttttaatttttatgggtatgtagtaggtgtacatatttatagggtacatgagatattttcatacaggcatacagtatgtaataatcacaggagggtaaattgggtatccatcacctcaaatatttaccatttctttgttataaacattccacttatactttattacaaaatgtataataaattattgttgacggcagtcaccctgttgtgtaagcaagtactggatctttttctttctttctaacaatatttctgtacccattaaccatttccaccccctgacttttcccagcttcttgtaaccatcactctactctctacctccagcagttctattgttttaatttttagctccccaaaataagtgagaatatgtgaaatttgtctttccatgcctggcttatttcacttaaaataatgtcttccagttctatccatttcgttgcagatgacagaatggcatttttttatagctgaatagtactccattgggcatatgtaccacatttttcttatccattcagtctgtggatggacacttagattgcctgtaaactttggctgttgtgaatagtgctgcaataaacatgggagggcagatgtctcttcaatatactgatttcctgtcttttgggtatattcctagctgtgggattgctagaccatatgaccattctatttttagtcttttgaggaaccttcattccattcttcatagtgatgttactaagttacattttcaccaacagtgtactagggttccctttttcgcacatcctcaccaatatttgatattgcttgtcttttaggaaaaaaaaagtgattttaacaaggatgagaaagtatctcattgttgttttgatttgcatatctctcatgatccttgacactgagatatacctgtttgccatttgtatgtctgcttttgagaaatctatattcagatcattgcccattcttaatcagattatgaaattttttctcattgagttgtttgaactccttatatattctggttattaagcctttgttggatgggtagtttgcaagttattctcccaatctgtgggttgtctcttcattttgttgattgtttcctttgctctgcagaagctttttaatttgatgtgattgcacttgtccatttttgctttggttgcatacaaagttgagtaatacccccaaagtgcatgcaaccaaatccagtgtcctgcagaattttgcccaatgtttccttttagtagtttaatagtttgggatctcagatttaggtttttaacccattttgatttgatttttgtatatggtgagagataggggttcattcttctgcatatgcatatccagttttcccagtgccatttattgaagagactgtcctttctccagtgtatgttcttggtacctttgttgaaaatgagttcactgtggatgtataggtttatttttgggttctctattctgttccattggtctgtagcataatttgaagtcaagtattagttctgtagtatattttgaagtcaggtaatgtaattcttccgtttttgttcttattgctcagaatggctttggatattctgttttttatggtcctataacaattttaggattattttttctatttctgtgaagaatgtccattggtattttgatagggattgaattgaatttgtagatttctttggttagtattgatatttttaacaatattgtttcttcccatttataaagatggaatatttttccattttttgtgtcctcttcaatttcttgcatcaatgttttaaattttcaatgtagagatttttttggttaattcccagatacttgattttatttgtacttattgtcaatgagattatttttacatttctttttcagactgttcgtcgctggcatatggaaatgctactggtttttgtatgttgattttgtatcctgcaactctactgaatttattagttttaatttttttggtgaactctttcagtttttccaaatatatgattatgtcatctgcaaacaggcatacataatttgaattcttcctttccagtatggatgctcttgatttctttctcttgtctgattgctctagctagggcttccagtactatattaaataacagggataaaaatgggcatctgtttcaggtttcatatattagaggaaaagctttcaggtttttcccattcactatgatactaccagtgggtctgtggtacatggctttctttgtgtgtggtatgttctttctatatgcaggctttgatggtttttatcatgaagagatgttaaagtttatcaaatggtttttcagcatcaattgaaatgatcatatggtttttgtacttcattctgttgatacgatgtatcacattgattgatttgtgtatgttgaaccattcttacattactgcgatagatctcacttggtcctgatgaaggacctttttaatgtgttattgaatttggtttgctagtattttgtagaggatttttgcatcactgttgatcagggatattggcccataaattcttttttttttgatgagtctctgtctctgcctcgttttggtatcagggtaatactggccttgtagaatgagtttggaagtattccttcatcctctatttttttttttgaatagtttgggtagcattggtattagttcttttttaaatgtttgataaaattttacaatgaagccatcagatcctgagtttttctttgatggtagactttttagtatagcctctattttactacttgttattggtctgctcaagttttgaatttcttcatggttcattcttagtaggttgtaatgtcaaggaatttatccatttcttctagcttactcaatttattagcatagagtagctcatggtagtctctaatgagcctttgaatttttgcaatatccatagtaatgtctctattttatctctgattttcttcgtttgggtctcctctcctttttattagtcttgctggagttttggcaattgtgtttttcttttcaataaactaactttttattctgttgttttcttttttcatttcaatttcatttatttctgatttgatctttattttcttttccttctactaactttggatttggtttgctcctggtcttctagttctttaagatgcatcattaggttgtgtatttaaagttttttcttttttttaatgtttgcccttattactgcaaactttcctcctaatgctgctttctctgtactccatagattttgtgtgttgtgttttgattttcgtttgtttcaagacattttaaaactttctttttaatttcttcgttgactcagttgtcattcaggaacatattgtttaattttcatgtgtttgtgtaattttcaaagtttctcttgtcattgatttctagttttattccattgtggccagagaagacacttgatataatcttaatatttttaaatgttaaagcctttttttgttgcttaaagtatggcatatctttgagaatgattcttgtgctgaagagactaatgtggattctgtagccattgagttaagtgttctgtaaattaggtctatttttatatagtgaacattcagtctgagttttctttgttgattttctgcctggaaaatctatccaatgctgaaagtgaggtgttggtcttcgtctattattgtactggggtttacctctctctttagcgctaataatatttgctttgtatatctgagtgctccagttttgggtgaatatacatttgcaattgttatatccccttgctgaattgacacctttgttatttctttatctcttcttacagtttttgtcttgaaatctatttttttctaatatgtctactactgctctctttttggtttccattgccatgtaatatctttttccctccctttattttcagtctatgtgtgtctttctaggtgaagtgtgtttcttctaggcaacagaccatttgctcttgtttttttttaatttagtcatctactctgtgtcatttaattggaaaacttagtctatttatattcaatattaagtaaagacttactactgccattttgttgtctgttttctggttgttttgtgattcattctctcccttcctccctctctccctccctgcctccctccctccctccctccttccttccttctttccttctttccttcctttcttccttcccatctttctttttgtgaaggttattttctatggtggtatttttaatttcttgatatatatgtttgtgtatccattgtgggttttaaatttgaagttaccatgagacttgcaagtaacatcttatattccattattttatactattgacaacactgattgcaaaaacaaacaaaagaccaaacatgcaagagaaagctagtaaaactttacactttaatttcatcctctgcttttaaacatttattggttctatttatattatgtgtatgtcttgaaaagttattgtagttattatttttgatcagttcattttttagtctttctactcaatatatgagtaatttatacaccacaaatacagtgttgtacaaaacacccatgtttttctttgtatttaatatcatcagtaagttttgtaacttcagatgatttctttttgctcagtaagtcccttttccttctgattgaagtactctctttagcatttcttgtaggacatgtctgtgatgatgaaatccctcagctcttgtttttctgggaaagtctttatttctctttcatgtttgaaggacaattcactggatatactatagataaaggtttttttcccctttggcactttaaacatgttatgctactctctcctggcctgtaagacttccacagaaaagcctgctgacagatgtattggagctcctttttatgttatttgctttttcctttctttcttttttctttttctttcttttttttttttgctgtttttagaattctttctttattcttgaactttgagagtttgattattaagtatcttgagatagtcttctttagttgtatctgcttcgtgttctataaccttcttgtacttttcaatattgatatgtttctctatgtttggaaagttctctgttaatatccttttgaatgaaagctttctatcccaaactctctctctacatcctctttaaggccaataactcttaaatttgcccttttgagggtattttatagattttgtaggtgtgcttcattcttttcttttttttttcttctttttcctcttactctgtattttaaataccctgtctttcagctcactaattttttcgtctgcttgatcacttgtgttgttgagaaactcctatgcattctttagtatataagttggatttttcagctgcagaatttctgcttgattcttttttttttattattatactttaagttttagggtacatgtgcacaatgtgcaggttagttacatgtgtatacatgcttgattcttttaggttattttaatctctttattacaattatctggtagcatttgaattccttctctgcattatgttgaattttgttgagcttcttcagaaaagctattttgaattctctgtctgaaaggtcacatatctctgtcagtcatggtttggtcactggtgccttatttagtttgatttttgagttcatgtgttcctggatggtcttgatacttgtggattgttggtgtttgggcattgaggagttagatattcatcgtagtcttcacagtcttggctggtttgtatctgtccttcttaggaaggttttccaaatactcaaagggaattaattgttgtgatctaagtctttgttcactgcagccatatctgcaataggaggcactccaagaccagtcatgttgtgactcttgcagactcttagagttaaccatctttgttttcttggataagatcaggaagaattctctggatttccaggcagagacttttgtttctttcccttactttccttcaaacagagtctctctcttcatgctgaactccatgaagctggggagggggtgacacaagcatcgccatggccatcaccattgggactgtgctaggtcatacctgaagacagttcagcactgggtttcacctaaagcccacagtgaccactgccttgctactgctgatgttcattcaaggcccaagtgctgtacaatttacagctgcttattccagccagcctattgtccttcccttcagaccagtgagcttctcccaagcccaagcaggtctgtaaatgccatctggaatccaaggcctggaatgtggaaacttaggaatctacttggcgctctgttctgcaactgagctgacacccaaactctaagacaaagtccttgtcactcttccctcttctttcctcaaataggagtctcttctcatagccaccacagtaggaatgtgctgtgtcacacctgaagccagcatggtgctgggtcttacccaaggttcacagcgcatactgcctgcctaccactgacgtttattcaaggcccaggggctcttggtcagaagatgataaatcctgccaggagtgagtacttcccttcaaggcagtgtgctccattctggcccatggtgtgtccagaaatgtctgggagctaggctccaaaatgggggcttaggactctacctgatgctctattctactgtggttgagctattatctaagttccaagacaaagtcttcttgctctcccctctcctctcctcaggtggaaggaaggaatctctctccgagctgtgagctacactgcctggggttgaggaaagagtaacacagcactcccttgactgcctagctggtctctcactgggttgcatgtactccaagtccactggctctgaatccagcatagcaccaggactgcagtcctagtggcctagactaccttcaggtttatttagaatgccagagaactttagcccacagtggtgggactagccaaaatttagattctgactgctagggtggatgattcccctctggctaggctggtctaaatgcttcctccatggacgccacctgaattctgccctctattgctttccttgtgatagggttgcactgaactctaatgcaaagtcccaagatcactgtgctctcctcccgcaagcatatacagattatctctctgggccaagaggctcctgctgggggatcagggagtggtggtgtagataatgcaacactgtctttcataccctctttagtgcctctttccttgatatgatgttaaaactaggtactctgctcacctcatttttgattcttataaaggagctttcttatgtggatagttattcagtttgttttttattctcgggaggatgatcactggagggttctatttgactgtcttgctctgccttctttcaagctgattctttctctcatgtctgctatctgtgacttgggggctcctttgtgaggcctctagctgcaactcccataccaggctgggtgttttccctggctgcccatccataccagccagcggtcttctatactctattgaatgcaggctctggctgtaaagtcgcctagcatctttaatgatattctcttggtcaacactttaatagtctgaggttgagtttctttcttgtagagttcatctttggaccacaagagacccacaggcatccttagttataatatctttcactgtatttgttttctcaggctgccataacaaactaccataaactgaatggcttaactaacagaaatttattttctcaatgcttcttgaaactagaaatccatgattagggcattggaagttttacttttaatggggcctctctctttggcatgcagatggctgccttcttactgtgccctcacatagttgtccccaggtctgtattgactgtgtcctaatctttcctttttataaggacaccagtcagattagattagagcccacccatgagaccttattttaccttagttacacccctctaaaggctctatgttcaaatacaattcttattctgaggtactgaggattaagacttcaatttatgaatttaggggaacagtattcaacctatatcacccacattatgacagaatgtattcccagaaacagcacaacccaccttggctcctctgccagagtgactcaccttcatcactcttactacctagatgtcatgggaaggaatctgactccagatcaccaagtcctccaaactcccaagagagacagctgaaatgcttccagtgatacccataaagtccttcttactaagctttaggtggaagaaataatgttctgtcttgctatgggagaggaaatgggactagcagttctcattccaaaaatcctccttataaaattctctcaccccactctcatattctaagcctgtgattttcaaccttagggatgccattgggattgagcaccaatgctcagaccctcagaagtacaactgtggtctggatcaaaagccttacattcctggaagcttgctagcaatgaagactctcaggtccagcatgagacctattgaatcaggttctacatttaacaagatcctcaagtgatatgtgtgcccattaaaatttgagaagtttgctgttatagactagtggttcctaaattttagtggacatcataatcatctggacagctttttaaaacacagaatgttaggccctatcttcagagttttcaattcagtacatctaggatggaccctgataatttgcacttctagtcaaatttcatggtgatgctgatgctactagtttgggaatcactctttgaaaccaccatgtgtagatactacactgtccaatactgcagccactatgcacatgttatagttatttgaaatgtgctttgcattgagatgtgctataagtaaaaaatatgcatcagatttcaaaaagacagtatgacaaggcagcatatcacatttatgattttttattgattatatgctgaaaggctagtatcttaatattgttgagttaaataaaacatattaaaattagttttactttttaatttttataatctgaatactagaaaatataaaattatatatatggttcacattatatttctgttgattggcaccgttcatcttgatctccatttggctcaggggtccctgaagtgtgtctaaagctgattcttgatcatttaccttgaaaatttattatttgctcttgtatcttactttaatatgctatatctgacaaatcttggcacctcagtgaaaattccagttttaacattccaggttacatgtataatattttggataatcttcatcaaatccataaataagacattattatctgcatttctccaaatgagaaacctaaatgaaaataacttacctaactttctctaactagcaagtaagatgcaaatatagatttgtctgccttccaagtccatgcttttccagttaaccatgcagccttcactctagcacagagatatgtggatgctcgatcttgtgaattttttgaaaactgtctgcttaagtatgtataactgcacctttgtaggagtttcatataaaagtaaatatatctagcagcagcttagtgtttaacaagacaatcatttcttcttaatggaggaatttaactagattgcaaatgttaccatctttaaggatggtgtaatcaagtaattgtgtttttgcatgtttttgtttctttgtttgttgtttacttagactcttgccaactcagactgttctcagacctggggcagcactggctatgttatattattattatatttataataattatttaatgtaagtatattcattctgtgtaactggatgctaactttgactctttcctctttgtttgtgccagacttctgaatagcccttttttctctgactttatgagtggtccagacacaagtaatagtgcagtgcaatagggagtatcaatgcaaaaattcttgaattctacattccaagttagctctccagagcaaattgactcaggccaaatacattttctctatgacactttctataacaaggtaggcagtatatttcctaagatattagattgtttctttttaaacttctaattaaatcacttagaaaaccatattgcagttgtccattgtatgtcaatatccctgattcaatggtaatcttgaggacacagattgtatattttttttaatctccagagacatgtaggcatgcaataaatggtctgccttggacttaccttacactaaaacccttgacactagaagtgggtgatttaaaaagaaacaaataaaaagtaaaaaataaataactcagagaaactctttaccttcattcatagttttcatttgactgttcaagaggaatatctaaggtcttatgatagtaaaattttcttattctttagaaagtctgactgtatctattttagaagccctatagtctatagtagtttttgataactatatgaattaatggatgaatgaatttccaaaaaattattgaaaactggatttttaaattaacatgagagaccagtaaacatttgtgtttgtttaaccaaaaaaaaaaaaaaattctattatctttgtcattttatgaaggacattctaaaaactaaagtatagaaaagatataatctcagaataaaaatcaaattttgaaaacataaatttatttttattttaaaattcaaggcactaccctatcacattccatggactctagttgttagttgtctgtggactattaggacagaaccgcttgtttgagatgcaaggtcagagtgtaaagggtgtgaagggcgatgggagagtctcatgattccctctcctttgtgcggcctctgttcactacacacagcaggagtgctttcgtagtcagctcacctatttgagctagttacccttttatctttggcttagtaaaactgccattatagaaagaggaaaaagccacaaacatttaagctgtaaaacgttagctcctcctttaatggaaagatgtgaaccaacatactttgtatatagggcaaggatcagagatactggaagattttaacaggcagagtaaccatagactttttgaaaggagaaaagtgttctataaccaccatgggtcacctgttgatcattcctcattagtaaagtcattatgtacttgccaagattaactgaatggaagcagaagtaaattcagatgtagataataccattacaggaggatatactttcttctaataggaaccaataaactctcatagtctttcaaaatgattcgtcacatgcctcaaatatttgcacaaaactggaaacataatttgcaactaattatttctctggatggatcctccatttataaaatgctagcaggagatctgcaaattctggcaaacataaaggctttgatggccatgaactacattaatataatattcaaagcaacaaagccaagacagaatgactaattatctaaatttcttctgcttttctctagttctatcccaataattgttttccaacatgatttacttcctctcatgcctcactgtatttattctcatacttccaacctcttcaaagcaagatggagctagtgatgactgatgatttgttacttttaacaattatgaaatttatttcctatcccacagcacaaaaaataccttgtctatttccctgcttttgctgtttagttttttatccagagaagcaaaactgaatatcctcccaaagtgcttcatgctcctgccaacacagaaaagttaatacagtttttaggtctaaaaattaaaaattaaaaacagtcttctctatctaacacactgggatctggtaaaaataaactgtaggaatcctagtgcactgagaaatgtcagcactctttcactttgccttctcttgtagtgggctttgttctctgttcctgacctcgtgcaatgctgtcctttgtttggcgtggcgcctagtttaccttttacttgatatagcttctctagcaatcacctttgattcaccagagatataaatctgcatttgtccttatcatggcctatttctagatctttgtgtatcttctttcctattcccaaacctagtcctggaccttgggacctcatcccaggcctcttccatcctacaaaagaagagtaagctcagagctgaacaaagttgaacaaagctaaactatttgccaaataaagttgttttgttttgttttgttttgttttaacagtacctcatttccaagtaaatcaatgtttgaagtaacagtgataatttgagataacttgagtcatttctttctttggagcctgttattcaaaattctctatcaaatagctctatgtaatatagtctgattttgttctgcctttcccataaggatggctacttacttgtccctcaactacttgattattacaattgcatgaaattttattccttactaagctctcttcatcaaacaaccaagcataccctcaccacaacatccacatgacctcagctatttctgagtgaatactgtagagcttgatttgtacagtatttatattattacaccattgtgaggaaaattgttaaaaccaagatttgtctcctgaactggactccaagtaccagaaagaaaataactatgtccctttgtctccagatgggttaaaaacccagcacatttctggatccttcctgataggaacataataaacattgaagtctggctttgtaaagaatcattagtctttctttgtaaagaatcattagtctctcttttcatatttacattttattatgagaacatatttctttttccccaggaacttaaagtactttaatttcttttgtaatttctttaagtataggcagggcaagataaaaacactttttttttaaacaacactagttaaataggcattcctttttccagtttttaatttttaggaatagataatgatacatatatgtgaggtacatttgatattttgatacaagcatacaatgtgtaacaaataagcctgggtaattgggatatccatcacccaaagcatttatcatttatttgggttgggaacattccaagtcttctcttctagctactttgaaagagataataaattattcttaacaatagttgtcttattgtgctactgaatgctggatcttattcgttgtaactgtatttttggacccattaaccaaaccttcttaatcccctcctcctcccttttcttcccagcctctggtaaccattgttctactctctacatccataaaatcatccctcctccttccttttcttctcagcctctaataaccattattctactctctacatccataaaataattttctttagctcccatttaagaatgagaacatgcgatatttgtccttgtatgcctggcttatgtcatttaacataatgtcctccagttccatccatgttcttattagtttattaaacaaaatttgtttgtagcctaatgagtaagaaaacactaaaacacattttaccaccaagaaaaataaaaacgaaaaggagctgtctatatcatgaaagtgtggattcacatacaaataaatgaagtatgtagtaaaaaaagtcactaagggaagatcagaattttattttctctattgaaaatgtggagacttggtttctgagcattatcatctgacttgtttgtcagcaagagagagatgtgctgctctattttgcatataatgacacttgatcagttgatatatcattgtgaaaaaggcaaagggcatcatgcattcactgacgtatatacagcatcaacaggtgttaataacaactattgcaaatgcttcatagaataacaaaaggagcatagatcagacaaggagtgtagatggtctgcaactgctcttttgagaaggattatgtctaacacaaagaattatttcattaccacttccagtactcttgaaaaacaacaacaaaagaatgtgaggtttagagactgattgattaaaccactctgaaaatgtgatttttaaaactgcagaagaggggaatgacataagatgaagaagagtatctctatagggagaaggaaggttaatatatgagtaagactaaaggaaacttggagaagtgagagaagaaccttttaaaacgaattcatgcaagaaggatttatataacttgctgtctatgtaaacatggctagccctcccattaaatcagtgggttccaaccttaaatgtatcttaaaatatccaggggaagatttgcaaaatactgatgcccagatcacaccctcagatattctgattcaattaaaatttcccagggttttatttattattattattattattatttgagacggagtctcactctgtcactatgctggagtgcagtggcatgatctcggctcactgcaacctctgcctcccgggttcaagggattctcctgcctcagcctcccaagtagctaggacttaattttttgtattttagtagagacggggtttcaccatgttggccaggatggtcttgatctcctgacctcgtgatctgcccaccttggcttcccaaagtgctgggattattaccagagttttaaattatctccagggttggcaaccatttcaatatgtaatttcaaaggagattttgttttgttcatattaggagagactagtcctcagtctttattcctataagataacaaaacactgagccacgttggcatctttgcatcatagtgcttgtccaacagagacacaaaacaactataccattcttctaaagctaatctcctatttctctcaaggaatagcctgaggtgtacttctggttgctctaaccaaaggcctcagaatgctcaggcttagagtttctacaaaagaatgataagtaatgcaactcctcttctccccagatgattttagaatataatcatcaccatagtcagatacctccattggccattttcccaatgatacctaatgacattcagagatagcttataattttgctcttttatgacaagaaaccaaagtagccctgtcatgtaccattataaaaaactactaattaatgacatggcatcatgtatattttcagtctgaagcccaaatgaatcactacgaaatctaaaattgaccttccctcattctttctcatattttcctctcccctaatcttccctctgaggaatgatagtgttatttatatcatctttctatctatttatctacacacctacctacctattatttatcccttctatctataatttttttcttatgaagacaacaaagttcataatagcaaatttggaaaattcagaaaaacaaaaagaatataaatcacctattgtggttctagccaatgataactaatattacttagttgtccatcttgttagtaatttaaaaatattaggatgatactatgtatataattttatatcatatacttttcatgtaacaaatatataaaaatatttttcaatgtaataaaagcttgatgcttataagactatctactgtagaaatatagtatacttcttgggcacatcatgggaagcattagatttaattttaattacataattattatgaattattttaggtctttgggtattttttaaaataagtggattgtatccttttccaaatttagttttagaaacacttgtacagatacacacacatactttctctctctctggatatacagataaatagatatccatcactgttaaactctttttgcagattatctcatttaatcctccaccaatcctttgagttaagcagttaagcattattatttttacagagtaaaaaataaaggttcagatcaaataaatttctaaagatcaggttcctctgacgttaatgttcaaaacattttcaccactctaccatattgtatcccagatattacagctaaggaaatttatcttgattttctccaacagtttcatataaatattttgaagcacagagtaaaggtgaagaattttctagtgagagtgagcactcctatccttaatatctatattttgccattaacacttttactgtatgagttttatcacatacctttgtttctactcatcttgatatccatccatttatctatattatttttatgtgtatcagtccttaatttttgagccctattataccactgcctaaactaagcaatggctatgataaatatattttggctgttttagttttgtttcttttttaacattttgttctttggtcataggtaggaatgatcaaacccaaataatattaaagatctagaaaatcacaaagttattttgcatcagtatcaccagtcattgatcttctaggaatagaaaaattaagaaatactatactgggtgaagtcaaaaatctgcttaaaaacactggggttgaaaatgtagtcattctactacttttaggtacagaggaaacaattttttgaagctatttaacactgatttgattttcctcatgattttagtcagatcccagaaggcagtgccactgctagtcctcatgatgcttttatgtatgtttgaaaaagtatccctgcctcaagatattgatttccctctgtcggaaaattgtcattatgaaggtacaagcctgcaatgtgaacatagcccgtcaggttgtggttcctgtgtagtacacaaccactgctgctgacttcagagatcctccgggaggttcctatagtggattcagtggatgatgtatatgccctgctgggcttgactctgtgacgctctggaggggatccttcccgtgagcctgctgcttaggtacctggctttgccccagcagctcctctggtgagcttctgagctgtgttcttcaaccagtttctcagaaaatccaggaatctaacctacaacatgagaatgaacaatggctcaaggggctactctctgcctgtggggtagccctcctctgctggagcagtcatagagcagtaatagagcagtaacactgccacttcagtaaagctgttttcttctaccctaccactaacttgtccttcagttctttcctgtgcaaagccaagaaaaaaacaaagtgggtcaatgaagctacatgccagagccttgtacctcaacatttcacattatgaggcttacatatgatatagctactaccatgaggtctttcattcaatggcctgaaacatagagctgaacacacagaatctcttgagataattttctaaaatgaggcaaaaaattacaatattggcatttctctttctctacgtttatttccctcctttgctgtactcttccacaattctcaggtatcataaagccttggctattcttttacttcttctatatcagctctttcttctttctgagtctggttgcagattaaacctgaggatgacagtgatgaggaaaagtttaatgtgagaattagccattgacggcttaaatggtgctaaagaatcttagaaaatcttcagtctctctctcttccaaaagtgtggtttaaggcagattatgttgctttaaagtcctattttgcataccaaaattaaatattaactctcctttttctctttacattgcttgtcaatttctcctacctttctttataccttggactaaagagaaagtcatgtgcttgtttaaatttccatgcaggtttaaataagctacccatctagattacattattatggttgcttaacaaatcactgtgccacaaatttagtggcatacaagaacacccagttattatctcatagttctatagaccaaaaatcagtgtgggttcaactgggttttctactcaggatgtcataagatatcatctgggctggccttaagcgggggctatggttaaaaaatctactttcaagctcattttagagaaaatgacttttaaatggctggtgtgattagattacactcagtgggataatctgccttttcattaactcaaagtcaactgattagtaactttaagtacatctacaaaatctttttgttacataaagtaatataatcaaggtgtgatatctcattatattcacagtcccagatattaggatacagaatcttggtggaccacttttagaattctgcctaaaataatttcttattttaaatcagaaagctaactcttgggatttctgtaactctttgtgtatagtaatcaaaatagtccttctcagagttcacagttacctgtgaggagattattctagtgataaaattgaatttatgcttttttaacttttattttaaaaataagaattttttatttgttgtatttaattatgagtgatattacaaagatcacatattttattaaaagaaaaaagcagcacaacataagaaaatggccaaactacttataaaatactagcttttaaatatttacttttttggtattctttatatatatgctttatccattatgaaatctggcatataattctaatgcatttaaaatatagaaaacatactgattttatttctttggaatattgttatatccattaggaagaaggtatgaaagaaataacactatattttgtgtaatttgtttattcattattccaaacatcacttggaccaccttcttctgagaatgttgaagtctagaaaatttaagccagattatgttgacgttttaccaaatccttgaggagcagaataatgttttgcaaagtgaggataagactacattgacatttgatgacaaaaaacttatgagaaataaaaaagtaaatttagaactagtgaaataaataccttgtttattcactacttggcttacataatttaatgaacagaaaaaaggtcaatgacccaaaaagaatagttcctatctgcactgaacaaatgctagaattatcctcttccaattactttctacaaagcttactatccaacgtcccaagcagtgctaacgaacaaagaaaccagaattaagcattcgtttatttaaaatatgtgaaaattcatgtacatgccaaaacatctatgtattgtatagacataactacaggatctcactagaggattttgagaaaagcaatgatattattggattaaggctctgctatatttatttaaaatatttatttgatttattcttattataaaactggtcagtgtgtattctgaacaataggaaaaaagatagaaaatttgaaagaaacaagtgattatacaggctctctcccaaaatattttactgtgactataatattagatgtgtttattctagactttctaagcaggtttttcagttttgatcatatatgtataggctgatgtattcacttaatattgtaacaagtatttttctatgttattacaatctcttcataaaatcagtttttccttattgattcttcatcttacatacattttataataaatattatctcacacttaattttctctgtgcttgagtgaatgtctttgtatctgagtgatttaattctttcatcatatgctaactcttcttcattaattttttttattcagctgcctcttgcctaatgctttcagttctagaaatcattgagatatgctatggcacaggttgtttatgtaaaattgagtgacaatgtttttataaaatagttttcccatttatttttgcaaaagctcttttgtactcattaaacatgcaaagatgatggatatgcatttatttatgtacctttgacagattgaaacatgcaagtgacagtgtttttcagctatttcatgacacaatcaatttgattccagaaaacaaatgccaaaaactgatgaattcttagcgaaaatttaggttagtgatttttaactttttcactgtagcctttggctacttaagtcactaattgcttcaacaaagataatactattatatatattcaggttatatccaactcaagtttacacttcagtagtctttcataaaagctatcctatctttaataccatcttttcggaataatgattctgtttagagattttccctactttgttggttcatcatagatttgatgctacagtttctcaacaacatacattaaattggagtttgccttcttttaatcacatttatttattttttatcttattcattaatctaattgggtcatgtatgagaagtttataaaaacaacttatcctcttcatcaatttcctctggattcattttgcatagagaggaaatcaaccataaaaattaattccagagtatataccagcttccggaattggagttgcatcaacacacacataagaaacatcagatggtctgggctagattgtttgattttgttgttatgtcattggctttgttttagttcctggaaaaaaatgaataagggatgactactcctttaagagcttcagattttcagaggtccttgcatatcgcctgcctatctattgccatggttctgttctccctgtgcacatcactgataagcaggagcagactggatgagagagggatagaggtgttgtaggaggaaggctctttgatttgcaagtagaaaaatagataggtcaaggatgagagtaagttggtagaaagttgaacctatatcagaaaaccaaaaacgtgtaagtagctatgaaacttaagtgataaacaatatatatgatattagcagagcatataatagatatacttactaattgacaagattttaattttatcaaattatatttcaaggacatatctaggaaacccttaggtgtagaaattccaacaaaaatgatgtatggtattatttcactatcataaaagtatgcatctgactcaagattggttttgtacaaatcaggcacattgtacatttcttcccctaggccatcctttccctaaatcccaagcattctcacctccagttggactgaaggtgtcaattcctggctagagtctggttttatgacttatgttatagaacataactcctcactctttaagggggagatgtgcttcgtgacctccttccaaagagtgctgtatggaaatgtgggaaagagtaacttcacagtagagaaacctgaaaaacaccacccgatcaaagtgagaaagttgagcattagtagtgataaattatgtctataatatatgcctttgttatgttgttatgagaatttttacctctgttgtcctcctccccaaactttataaccctagcttaatcatgagaaaaacatgagacaattctcagttgaatgacattctgcaaaatacctgaccaatactcaaagctgtgaaggtcattaaaaacaaggcaagtctgagaaattgtcagaccttagaggatctaagaagccatggcagctaaacatagtgtggcattgtagatgggatcctggaacaaaaacagaaattaaataaaatctaaggaaagctgcacgaagtatggacttcagtagataatttgtatatcaatattgattcattaatttcattgcaaatgtactctactaatataatattaaaaataggagataaaggaaaatttctctaactgtagattgtaggcattttaaaagacagtgccttgcacttcctttctctattttctgcatagaaatagtgaccctatgttatatatttctgcctaaaataacttgtaccatacaaagttaaatgtttaattctttcagaagaacgttgcattaatttctacccaactactccattgttcttctcttatgttcttgtttaccggctcttgattgcaattcttccttatattcagtgctgttggagtatccctctgacacatcttaatgaacagatttatggttgtctatctttctcaagaggttatcagcttttaactttgtctttaccatgtgtacttgaatcttgaatcattgtggttttggatgataactctgaatgcaagattctgaaataatacagtttaaaccaaacaatttaaattggcaagtgtttaaactctgtgctaaagagtgattatcacatgctgtttactttaaagctatatagagctttgtcttatacatgaattaaagcatttataaaacaaaataaattagaaaacagtgaatcagaagtacttgactaaaagcagcaaagtagcctcagaaggaatctgaacaaacttgacctagtgaggtataaagtacaaagatggttgaaattgagccaggagtgaagccctacctaccaggacatttaggttggaagatgtccatatctggagtttccttccatcagactcaacagatggacacggtaaaagttatgtgcgcatggtgtgtatgagagtatgtgtatgtgtgtgtgtataaactggacatgctgtagcatgtaaaaattgaattacttcttagaaatatttgcataatgcttttaaggcaatatgtttaactgatacacacttggaatggtgaaagtgtgaattagggacactgttccaaactatgaataaagtggtggtttcacccagcactagatccagatttgggagacaccttgagaattatctaatcagtcattaagttaacatcttttttttagagtttgttgtcatttatttaaagtggttacctcattttgtagttatcattacatccagacaataagggatgtggttgaatttcaaaagttttctaacttaacaagtcttattttgttagattatcctcacttaggtcttcatataaatttgtaactatttcttctgaagacatggagttttatttaaactactgtatttttgttttatcatagaacaacagaattcttattacagaagttgaaaatttttaatcactattggatattaactgaagttctgtttctaatcataatgatacatttaagtgcctacatgtggcatacatttctagattctttgagtaaaacatttgtatgacatcaacatctgtattgccatcaggagtgtcatttctactggcaggggcagccacctggaaacctgaaggaatcatctacccagaaaaagtgatagggcatatctgtggtactaatttttgctttatttctattgttcacagattggcttatacagccatttattcatttagaagttttctctgctaaggcaccttcctctcctatcgcaccactcaaaatttggcccatctttcggaactcagttgaaatgccattttgccattaagttgattgaaatcctctcaaatatttatgatctatcccttttcagaatgctagtaacttttttactcttttgacattctcttatgttgtgtcttgaatgacagttgttcctgtacagatcttagcactcttattagcctaccacgcctggaaagggctgtctgcccctttgtcatccttggcctcatctgacacacgacactatgccctccatgtgatgtcactgcctgtcaccttatgtttctatcctgcgttgtatactcacgttcttccatctcacttccctgctgtctcctgtctttctttagaactacattttcctctggtcctccttctttgagcatgtattatttttaatatgctccccatccatataatcctggctagcctctactcacttcttaaccacaacgctcatcactttaagggaagatatcttaaactgagagggtttggaataaagtggggaagtgggatttgtcaaacagaatgaaagcatgcatgcaggtgacagtcctgaatgtgcataaatgacattggaagaaagcagaaagacactggatggaaatgtgcaaatgaaagaagattccatggattgggagagcagagaagtgagaaatcatccttaagtgatgttcaagaagaacagaggagatgatattatctccaaatttacctgatcataagaagtatcttaccaacgtgttaagatgtagattcctgagacccgccacagtctagcaaattataatcccttgagacagcctgcaaatctgattttaagaagcttctcagtgatccctatgatatgaattttgagaaaacctggagaaattgatggtaatgtcacagaaacataaaatgttaagagaactggggatggagtagggataggaggtgggacaatttcttcctcttacaatacgggataattgggccaaaagcaggggtgcagggcagagtcctaatgcacaaagtgctttggcctccttaatgagcctgcattaactctgccagctgaaaatatttctcagtaaaatagggcaaaaggcttttacaataagattactaagattttgttaagtgtgtttgaccattaagggaaaaatgtgaaaagttgtgagatattttctactcctgaaacaatcatttcctattagcattttagtcataagtttacttcactagctcttatgttcttagtttcttcaacctactgcagaagaactgaaaacattattagagtaacatgatatgatgaaatcatgagatttcaatcagttttacaacagagctgaaaggtgatgttttagagactgtcaaattattttcagagactcacactagactatttcttactgaaaatatttaaatacagcagaatttaactcaaagttctataaaaagtacattttataatattggtattaaaatgtcttatatcagtactatataaaattgctgtttttgtttcagtctgaagactagtatagttagtgaggatgttaaaacttgacaagaattacataattcttacagatttaaattgatttctttcaactggacttatgcactggacttttcaaagagaaaagtatgaacaagggcaaattcatatttaaagggaacttttcattaaacactttgtagtctactctgtcatttttcctccaatgaggaattctatctttcgttcagtgcacacaaaaattaattgtaatcagcatttttgttgcctaatgtctcatgtagttaaattttttcttaaataaaaaataaatagtaatttgaaatttaaaatagcattttatggagaacagagtattaatgagccagcatgtaaaaatattttttcattttacaagaagcttatttaatttttaatattcaattccaaaaaatacaaagggataagcagaagcaaagtttggctgtgtgtattttataagtcacttactaaataaaacatttatttccagatattttctttagccacatattaatattcaacctagcctagtccctttgaaaattgttaacaactagattccttatttcatgtcctagtgatatgtaacagtaaaatgtgatttttactcaatgcataagtgagagatcctttgtttatttaatattttcatcatttccttgagtaaaaatgataaatatattatttaccaagaaaagataaaaagttctagctgactcttggcatgacatagactgtgtgatacaatccagttgtctcatgaggaatcaaagaagcctagagatctgttacagttgttactaaatatcctttaactggttctgtcctaattcaaagtattttcatgtactgcatgacacaaacaaacaaggtagagaatttttctgaatgtaatacaaaagtcagggtgtctcatttgaggaaagatgcactgttagcatttattttatctttaagcaaggtaataatttataattatgactgattcacatataatctgcagcaataacaaatcattaagcaatgaattgtgaaaggtaatgtcctagtaatttggttatttcagtacatcaggtgtttacttattcattttaactgtttcccaaattttgatatagttgtcaaataaaaccaaatgattgtaaggtatacaaggtgatgatttgatatacatatatttcgtgaattaatcaaattagtttacatgttttgcctcactgtgctgtatattagatcccctgaacatatttatcttccaactgaaagtttgtactctttgaccatctccctttttttcctgctcactgcctctgatagccaccattctactgtctgtttcaatgagtataacgtgtttagattccacatttaagtgagatcatgcagtatttgtctttctctgtatgacttatttcacttaggacagtgccttcacatttcactcatgttgttgcaaatggcaagatttctttcttttttatggcatcatatatatgacatttatatatatagagagatatcatatatgatatatattatatgccacaatatatattcatatatagaataatatatctaatataatatatgtatagtgatccaaaagataggtccaaattttatataatcatataataaatgtacaatctataattatatataatgtatagtataatataatatataatattatatatattattcaggggtggggatggggttggaatgatgttggtcaaagatacacaatttcagatagcaggagtaagtttaagaactctattgtacaacatggtgactatattatattatacaatatatatattatattctagaaaatgccaagaaagtggatgtaaagtgttctcaccacaaaaggaaccatgggagataatgcacatgctaattagctatatttattcttactgaaaaaataactgtgaagtaacatatatgttagttagctatatttagtcatttcacaatgaatatattcttttttttcctttccttttcttttttttttaaaagctaaatgaaagattttattagtcttgggaaaaaagacagaaacacaataaaaacttctctagtatgaacatgtgcaagtttcacaatcatgctattacattttgcactggcagacagttcaaggcgtagttatctgtcagcctgtgtcagatagcttggtagccagcagcagtcttttgaaaacacaaccaataaaaataccagatctaagcccaaggctaaactgacacagaggtcttctgaaaccaaattatggtagaaaatatgaagatgaggctttgataattcaaagcaagactcaccattataaaactgtatgatgattagggctaaatagttactttcatttaaataaaaatattaatacactgttatgtcagataatcttatagtattgagaattgaaatgcctgtcatgtacatgatgaagatatatgtaatggaataaatttgtagggttttttgggcattttgaaagtgtattttgtattattattgtccttttcttatcacaataaatatattcttaaaagcatcatgttatacagaatacatacaattttgtcaattaaaaatttttaaattaaattaaatattttaaaacataaaaatcaaatgacccttagatgttgaaacaatgaatcataaatgcccaactcatttaatcaaaaccacttttttgtaatgtattatatatttagatatataaaatgtgtgagtaatattataacacatatatttttaacattgagatcaaaaactaaaacactgttaaactaataaaaagtacaaatacagtaatatatttaaatttaaagaacttttaagcaactattggatgaaagatttgtgagtacaatttatagatgggcactaatgtttgcatttagtgcttaatttagttaagctagaaataaaatatagatttattgatactcacattgaaaaatagttaaaaatttttgagaaattcacatacaaaacctaatcctttaaacctcatatattttcccacaataacatgcttgcatttttcttgcttttcttattattgaatattgactatgtttaggtcctgttttaagcagtttacatgcagtgtatgttgtctcatttatctataacaagccaattaaatagatagcaattttcatggaaatactgtctaaatgacaaaagttatgttatgaaaggtggcattcttttttataactactagagaagggggtggaatgtagtcattttatctactatcatgttatttacctctaattgacaattttcacagatttaaaagcccttatatggtatttaaggacttaaatcagctatagtcttcttatctcatgttgaatagtatcttcaagctggctctataaataataagtgaatggatgagaaaaaaaggaagtgaaccaaatatgttaatggaaaaaatgttaacaaaaaatagaggattaatgaattcaacaactcttaaaaatcaactgttcaaactactttctatgtaagtacaatttgagtctattgtgatagagaagtaaactcaattcttgaatgtgatttcagtataactctgaaggagtctgcaatggtgattaaaggcagttattgcacaaggttaccaattacatttgttttcacacagctatatactttttttttttttcaaaatccttaccaattttcagaggaaagggttacggtaagctaatgtaccactagatccctttcagtttcattttcagagtgatagtaattgtttcatatgtgggaaggttttctgagactataatagtacatgcgtgattttgtgtgatttattcagaggctcatcagcttctttaggaggcagcaatgtaacagttctccagaggagacagtgccatagtgaaatatgggactaaggcactgcagatttagcccagacccttgactctgaaaagtcagaataatacatttagttgttttgctggacattgtgtaaatattttggaagagtgtgctttattttgctaagttcagaatgcacagtgggataatgtgtgatctggaacttgcccaatgtatgtaagagctgaggcacatcaacagagaggagatattggcaaaccttttacttgcagttcctagaaactgaagagctatgtaaccagaatatagaattactttcaatcataatattttagtatgagaatgagtcatttagcatcaactctttcaatttattgatgaagaaactaaggctcaaagaaattaagtgacttgctggaaattattactaaatggatgccagaatcagaatgaaatcaaaatgttcagattcaaagccaagtgctcttctgagtgcctcgtgctgcctcttacattagactacttctgacccacagattacattcaatttttcgacttataaatagtgttctcttttcatagccacaacatgaatcatacaggtgaaaacccatgcctttatggtaccacttcctttattatgtcaattatgtttaaaagtggtaaaatctagcctgtttgtgagtgccatagtttcaggaagagtagttttgtataggcattcttaaaacaaactttcatgcataattgtttatttaaattaaaaagtatgtaacaaaaagagaggagttttgcagtataatgtgaaaatgtgatcctgaatgagcaaaaaaaaaaaaaaaaaagggaaattacagcaggtcagattttatttttattgtgggcaaggactggtggacttggcactggtaatatctggttagagattttaaaatgtattcaaaaaagcaaatcaatgaaaattaaacaatctataaataatacttagccatcataattaaaacagctaccattataagacagacctatataagaaagggtgattttttttttgtttcccatctgactttggctatatcttttcagaaaatactttgtaaactttggaatctcatgaataatttagttattcatataaagtatgatcataaaaattaagaggatgcatatagaacagttgaattacttacacagggaatgtgactttattttatgaagctgtgggtcttgttgatttaaatagtttctggggttttttttgttcctggttgaaagattatgttgtattatgttaggctataattgtgttattcataggaatgaattgtataattatagtgtggtgacggcatgcaggtaaccatgactactactgttcttccatcaatttttgcttctttatgcagtggtgaatatttttagtggttctattatttgctcttttaaaacttagaaccaaaattataagtcatctctattaaaaaaaagtcttgcataattttacagggtcctccttttagatacttaggtatggaatatcaaaaaggaagctcatggaaagagatttctaatttaaacaaaaatgtgtatcagtggggccaccatcttcatttttctgactgtaatatttgcatttctggacatttttttctagccttcttctctgtgtaatcattaattcttggctatattttgtgtatcagatttctgaaaacttcctcttctgtttcattcacacaaacactattattgtttaggccttcaccactcatacttggattattaaagtaccattctgagtggccttcattttattcttaacagtatctatcctgggcttcatcttttcttactaatccttttggcttgactgcattctaaagtaatataaaactcacaaaaactcatcacaaaactgttccaaagctaaacatttattctttcagagactgtagatctcaaagtgaatataaaaatatttattctgtaaggagcattattttctttacagacactccaactgatgggttacaaggttacaaagcactgagtgtcagaagccttggaggctttttaggctacatagcagtgtatatcacagagaacatcacagattttgttgttgttgttgttccttttatagttatgaagtctactgcaagcagaatcacaaggtcaaggtcaaaggttatagaacatttttaatactactgtgtatgtagatggaaatacaaataagttatagctgctaattttgatgcaccaattttttattctctggtaacataaattacttgagataataaaattattcattattgaaacttcatattgaggtaaaattattctgttattgcagttgtagaatgttcccttcattacatgaaaactactcttacaaatcctagatccacttattgactctgatagcagagttatgacaaaatctgataatcaatagttatagcaaatagctcagtctttacttgcatatctcaaaaagcagaagtgtttccaaacacaacactaataaaattctctttccttctcacctctgtcattacattgcagaccttccacactccttagaaacttattctttcaccagctctaagtgatttttctccttttctacaccagattctttattatgtaaacataagtggcagttctctacaagacataattagtctttaatttacagaagaaaggagaagatgggactagatactctggctggatggaaaaggtgtggatatctatgaacaatctccagttaattcttttcaatcacaaaaataatggtttttgtaattagatttttgaaaacaatttttatgggaatatatatatcatgcaacagtatagctgactgtgctggaatttggtaacaaaacctttacatttaaacaggtctcaaagcaagggcattttttttctaggtaaaataatggcttttattttcactacaaaatcctttttaatctctcagattataatccagagacatctcaattgtcttcctccattaaaaaaatcttttagaccaatattttccctctgcttaattccatgtatttggaaggtaataacaatatcgtgcctcttatcatagatgggagaatttatcaatccatttttaaaacacctcatattttatctgttcacaattgtaaaggcattcagaagaatgtgcagtgacattatacaaaccagtcttgaaacctcatttatatcatgcattgtgaagaatgattatgttttgtttgtctgattttcaatcttgtatggagtaaaactttgaaaaatataacaaaaattagataaaataatagttattatatttatcatattaataatttaaagtatagcacaattgatgtggttagatgccatggccatattaaagtttttaaagctactttcaatgtcagtacatattcacttaagaggtaagacatagttctaataaatagttctctcaccagcaaacactgttaacagagacttcacaaggaggcatattttcaggagaggcttctccagactattcaactcacctgagctcctctgcaaatgtagattaatttttttttcttaactgatcacattattattttcttagggtgctaacaatgtcaccacaggccattgagcacttctttgtggactgacagaaggtgttccttcttcatgacagggtcaatactgcactgggcaggtggcttgaccagcagatgaagtgcgtgttggcctccatcgtcttccaactgtgtgcttctgggctgggacacgaccttcagcactatatgcagcagctgtcttacctggtccctctttctgatttcaatgcctaagtttcctttaattcattctcagcctccactgcagaggaaagcttggcagtctttgggcacaagaagttgcatataatggatgaggaatgacgttttaaaattagatttcataaagaatctagaggaggcatctcttactacctacgctaaatgagattccatctcttaattacattttacaaaacataagaggcattttacaaaatgtttacaaagtgtatcttctcgttaagctagtttatgtttctatttaatccagctcacaaggttagggtgagtataggattgggttttccgggttcaggaaacacttcaaaggaaatcatactttgaacatgttatctaaagttatccatgattttatatatatatatatatatatatatatatatatatatatgtcaacctaatataatacatataattatatataatataatatatctattataattatatataatatatatttatctattataattatatataatatatatttatatattataattatatatgattatatatatttataaatatatatatttttgtaaaaagctttgaagtatttataaaaagcagctgtatagaagcaaataattattcactgtcttatgttgacagcatggaacaaaaggcaaaatcatgactcatgaaactataaggtgaatatatgtcaaatcttttatttaactcattaattaataagagattcagtaaaatcttaggaccagctcaaaggaaacatttaaagaacataggcttccattaagtggaaataagtttgttaatatatgcaaaattagttaataacctataaagtaataaaatgtcagttttctagaaaaggaaaaccaattatatctcaatttatcagatgtaatttatttgcatttctatgaacaataattattctcatgacaatcagtcttgtgcaagttaacttctacttttacattagtctagataatagaaaatcggttaaagttattcatccctattgaattagataatccccagatagtctatcagacagcttctaccactttgttgaaatgatgcccagtaatttcatttgctgatttccaaatcttagacatttttcttgacacacccaaatatattgcatcagacaaccagtctctaaagttaaaaaaaaatcacagtttctatgtattttttcattacacaaaaaaccaaacagattcttgaagtcctactctgaatcatataaagttaatctgtgagcacccaaaaaaaacagactatcctcagtatgctcgccatttcactgagaatttcattgatgagccttgttttctccacagatactacatctgcccatgctactaagtctcagatcaattctgagaaagacaaagagctgtattgatctaacaaacacatattattgccacacatttcttaccaggtctttcctgatgcttataacattcccccaacactgtccctcaatcactcactgattccagcacagttcatgcagctggtggcagacttggttctctctcattagcttccaatatctcccactctccacattctcaccattatgagaataccttacccctacttaagaagaaatattgagaccatctggcatgatatcccgcctttattcccatctttcactcagagcactgctcatagaatcctaccaaaaaggaaaagctttcctttcactttcaagtagacccttacactctatctgctcccatctccttgaatgtagcccatgtttagcccctctgtcttaagtaactttcatttttcttttccagtgatgttttccttgttacccttgaacatgttcaggtttctctcatgctcgacatttttacctagattagctacccttctcactgtgatacagggtcatatacctgccagactcctggatcatgagtatcctaatttgctgcttccacaaggtacttgcccattttatcattaaatttctggatttgaggtccacatttgcttgacatgtgactaaaattctgttttcaaaggttatcctttggtctcagaattcttctgcaatttttgacattttgattttcacttttcttcttttatctataacacagcactttcttggttctctgacttctttatcactttcttaatctatttactaaaacatttatctgttatcctttattcttgatttctaatcattctcaatatgtgatccatagtcataatttcattgtttcaattattgaatcaaatatatgtatccactctcaatcttctcaatttcaatcacataattccatttgctcacaagataaatattttcttagggaaatttaatacctgtcaaattgaaaacactatatatcttgacaatggagcttctttcgtgtcaacctaattttaattgatgtgcaatggactgaatgtttatgtgtcccctcaagttcaaatttgaaatcttaacccccagagtgatggtattaggagaaggtggggcatttgaaaagtgatgagggcatgaaggcagagcttttatgagttagatcagtgcccttataaaagaggcctcaaagagatccctaatctcttccaccatgtgaggacacagggagaagatgctgtttatgaaccagaaagtgggacctcatcaaacaccaaatctactggcaacttcctcttggacttcccagcctccagaactgtgaactgtgagaaataaatgtctgttgttaataagccacagtgttatactattctatggtgttttgttatagaagctgaaatgaactaaggcagtgttaacacatctttccaaatcccatgggagagaagaatgtcttttaattccctatacacatttttactaaatctcattttccattatttcctcagctctaaatctatcaccaaattcttttattaagtttatatttactattttttatatctattattgtatatacatatgttatttcccatctagattataagccacctaaacaaaaggactgtttctcttatcttttcttggacctttggaacaattactgaataataaaagataataatactaataatacattgcgaagccttacctttttcaagtgacattaacatttatttttaaatttaatttcataactgacactcagagaagtcaaagaggcattgctataggattcacagcctataagggacagaaacggaaccaggaattgtttctaggatacttcttcattacagtattgattaagtggctggtcaacaaaatgatataaagtggggaaaaaagtaacccatatttacccgttaaagttgattgttactcattcttagtagagaggttctctctttctctctgtctcttttacttctggtatttaggtaacatgaaatttccttggagggttcctaaagcaagtaaaaatttagaaacttgagaagcttccatactaactgggtaacaacaatttgctcactgaaaatagtttcaataaaagcacttaatgggtttttttgcactactcagaaaggcaaatctttctgtattatttactttgttttcccacccaaaacaataaaagtagatatttttgatgtaaagagttacatgttgtaaagctctctcttttaagggctgcatttcttttctaccattataaagcaaacattattttgtgtttcaaaccagaatctaaggctgtggaaaagtcagataaaatttagtgtttcaaatgttatgttggaacatgtttctcctataaaatcctagagtttgattgctgtgttcctacacaggaaaagtccacaatgttctgttgtaaagagttaatttattattgggcaaaagtttttgattgactccaaataaaattatgtattagtccattctcatgctgctatgaagaaataccagagactgggtaatttgtaaagaaaagagattcaattgactcagagttctccatggctggggaggcctcaggaaacttacaatcatggcagaaggcacctcttcacatggtggcaggagggagaatgagtggagaatgagtgcaagcaggggaaatgtcagacacttatagaactatcagatcttgtgagactcacccattatcatgctaacagcatggggaaaacccttcccatgatccaattacctccacctggtcctgcccttgacacatgggaatcattacaattcaagatgaggtttgggtggggacacagagccaaaccatatcattctgcccctggcaccttccatatctcatgtcctcacatttcaaaacacaatggtgccctacaaacagtacccgaaagtcttaacttattccagcattaacccaaaagtccaggttaaatgtctcatctgagacaaggaagtcttttccacctatgaacctgtaaaatcaaaagcaagttagttgcttcctagatacaatagagatacaggcattgggtaaatacagctgttccaaatgggagcaattggctaaaataaagggctacagattccatgcaactccacaacccaatagggcagtcagtaaaccttaaagttccaaaatgatctcctttgacttcatgtctctcatgcaggtcacactgatgaaataagtgggctcctatggccttggggagctctgcccctatgtctttgagagtacagcccccctcgcagcttttatgggctggctttgactgtctgtagctttactaggtgcacagtgcaagctgttggtggatctattgttttgggatctggattatggtgggcctcttcgcacagctccactcagtagtgctccagtggggacactgtgggggatcaaaccctacattttccctctgcagtgccctagaagaggttctcaatgagggctctacccctgcagcaaacttctgactgaatatccaagcatttccgtacatcctctgaaagctaggcagtggctcccaaacctcaattcttgacttctgtgtactcacactttcaataacatgtttaagccaccgaagtttggggcttgcgctctctgaggcaatggcctgagctgtaccttgacccttctagccatggctgggacacaggacaccaagtcctaagactgcataaagctgaaaggccctgggccctggccacaaaaccattttttcctcctaatcatcagggcctgtgataggaggggctgccgtgaagacttctgccgtgccacagagacattttccccattgtcttggtgatcaacatttggcctctcatcactcatgcaaatttctgcagactgcttgaatttctcctcagaaaatggatttttcttttctattgcatcattaggctacaaattttccaaagttttatgctctgctttccttttaaacattccaagccatctcactcaagttcaaaattccataaatctctagtacaggggcaagaggccatcagtctttttgctaaagcataacaagggtgacctttgctccacttcccaagaagttcctcattgtcttcttgagaccacctcatcctgaacttcattgtccatatcactatcagcgttttggtcaaagccattcaacaagtctctaggaagttccaaactttcccatattttcttgtcttattctgagccctctaaactgttcaaacctctgcctgttacccagttctgaagtcacttccacatttttgggtatttttacagccaacgccccactactcccagtaccaattttctgtattaatctgttctcatgctgctatgaataaatacgcaagactgggtaatttataaagaaaagaggtttaattgattcacagttccttatggctgggtagccctcaggaaacttaacaatcatggcagaaggcacatcttcccaggatggcaggagagagaatgaatgcaagcaggggaaatgccagacacttataaaaccatcagatctcatgagactcactcatcatcatgatgacaccataggggaaccgcccccaagatccaattacctccacctggtcctgcccttgacacatggaaattattacaattcaaggtgagatttgggtagggacacagagccaaaccatatcaagttatttcaatattttgtcctgaaagtggtaagattttatcagagaaaggtaattttaaataagccatgctcctgcgagcagttaagagagaagaaacatatgagaattagaaagctagtactcactataaaaaaaaatctagttaatgaatatacttcactt

SEQ ID NO: 1233 - DNA, 6499 bp, Homo sapiens
gtgacctctagaatcttaactgagttatcctacagtatgaaaatagataggatgtgggcggttccactttgcctttggctgttataactctcttggagcaagatgttctgcaaaaatttctgaaatgattctttcattgatgtaaacatggggacatccatttggaggacattctggcacttctactttctatctcccctgggcatcccatagggaagctcaaacaatgggggatgatgttatgagtttacactctaagaaaacagtgccctcccaagaagtcctcttcaggccgtgcacagtgactcatggctcatgcctgtaatcctagcactttgggaggctgagacaggcagctcacttgaggtcaggagtttgagaccagcctagccaacatggtgaaaccccgtctctactaaaaatacaaaaattagccaggcatggtggcatgcctgtaatcccagctacctgggaggctgaatcaggagactcactcgaacccaagaggtggaggttgcagtgagctgagattgtacaactacactccagcctgggggacaagtgcaaaactccatcaaaaaaaaataaaaaataaaaaatgaaaagaagtcctattctataaaatcagtgcagctaccagaaccatgggtgtcagatgtgcacatccagcagaaggcagtcttgcactccaaaggcactgactgtgggcccccagttcacgcactcaatacaatgggcttggctcttggagtggaagtaactgaatgccttcttagttgtttaagttttagcagcttaagcttttgctttttgtgggcttagcagttggttgacagagtagttgcctcggctctgataggttttacttctttcttcatgcttcgctgtgggagcagacaagtggcagagcagcaatgatgagagtggaccagcgctgcagacatgtaaccactgaataaaccaaaaatcaagagcctcttggtgacatgcacatgagcgactcgatgtctggatccttggcactgcgtatgggagatgaagtgctttcagtttgctcattagttgatttcagatgtttattcttatacagatcttatgtggacactacatccaaaacaacatatttacaaacttttttttttttaaggaaagcacttatatcacattcccagtaggtacacaagtgtatgttcatgcattgaagtgaaaatttcttagatcactgctaacctttgctacatgaaatgactctgatatattaaatttcattttgatttctatttcattaaaaactatagttgatacctataaaattgacttcacaatgcactattgggtcaaaatttccagtttgaaaaacagtgtgcctagacagtctggtgaagttcagtttccaaactaatcatccgcaggtctcctagttcctcaaatgcacatcttctgactcctttaggggtttcctatcctctagtgttgatgtcttcctggggcagccctctattctgctcttgattgaatttcctctccgatatcacctgcttgcctggctatgatgatcattgctgctgtagtgattcataaatgtatattcctaactgtggttgcgttcctgaattctgtatgatgtttccagcagcattccaaacagtttcatgtagccttctgttgtacccttcatcttgaactcagcaccaaaatcaaaatcattattttgtctaaacactgcaacttctcttcttagtctattaatggctctcttattcccctatctacctagcctaactattccaggccatcactgactcttcactctccttcaccctccgcagctcacctttcctcagctctcgttaattttttgctcacaacttctctctcacttttccattttgacaccacatcatctcaatttaaaaaaccaaatggcttctcattacctacagagttgaatgttaactctttagaatattggactttggcctcaaatcttatctccatcattgccctaaatgtgccctttgctgcactaaacattgatctcctacttatgccctaggaagaaataaatattttctagtttctcaggaataagcctcaatttttttgatgaatgtgacacttatcatgcatttccagctatataatgtcactgtttggattaatatttatttaggttagcatattattaggtactttctagagagttgtgatctgggagtcaccttgaattgctctctcaacatcgaaagggtaactaagccatactgatactgtcccctaaaccaattatcctaaaactttcatgtgcatataaattatctgttagaataaagattcttattcagcaggccagggatgtggtttgagattctgcgtttctatctggctttcagaaaatgtgaggctgctggttagagacccacactttgagtagcaagattcaaatgtggctttaacccatcccttcttcctccatgccactttttgggtttaagaccttattattacttattctcctgactggtctatttgccacctgtccctccccaccactagtctgtctcataaaaccattatctaatggatcattacttcatttgtgaacttcctaaaacaaaagtgcaatggaaattagaaatgcgatccttagagacctggcctctgaactaggattgggttaggcgccttgcttgggacatccttattctattcctgtttctgtggtttccttcttctctgctcattcattttgatgaaattaattaggctgttctgcttttcccaaaacactgattttctttttgccccagcccaagccaggccccatatactatggcacctggatttttcacacaacttgaattttcagaaacaccttccatgtgttccgttttcaatccactgttgtgaaaactctgtgggattcaacaacagtgggattgaagaagctgaaagttgataagaggaaaaccgtttgaaggataaatgaagtagtccatccatgaaagctagcctcgccctcttttaactgccctatggtcattttggtctccctgagtgggggtgtcatcccagttgtgggtttgcacaggggcctgtgaatttcaggcttttgctcttgtggaactgccttgtaggttatggggagcaatgctttcacatgtactgcttttctactgtattttactttatatttattctttcatttatcttcctttttactgctggctctgttgttcagtattagctaatatattgcaaagtgagctttcattgaccaggcagaggccagggtagggccactgagagattctggagaacaacagatggggaggaagcagaggtgtgcagcgagattcctgggattgggatcccagctctgctgacatgtctgtacagtcttggaagtgtgatctagcctctttggcctgttcctccaatcctgagagaggtggtggaaacagatcactgcttagcaggccttagggataagttactagggccacacagaatcttctatttttttaaaaaagcaaacacaactctcctccctataattatactacactgccctcaatgccagtgaagttttcctttgccctgtaggtagatttttgtgtgaccttctcagaagcaggaaacagattgaaaagccactaagatgtgggtcaaaaagtatttttcattctcatatgtgtccctttgttgcaaagactgtgacattcctccatggcagaaaggaatgaatttggaagaaaaatcccaacataactattttccaccctaaggaaacagcctctctttgcaatgtgtgaatgcattttccactgcatccccaggggtatgagtgtttcaagaagtttgcactgtgctgctacattcactaagcccccaagccccactccttcccagaccatcctccagagtccctgcaagtttccagaaacaaacaaatcaagagactgacaagagctctgcctggtatgaataatagaaaaatgagccactctgtgcaaggaagttggtggaaggtgggaggcaagcaggggagagaaagagattttcagcagcagaggggacctcagagacccatctacaagacggacacttcgctcagcgttatttctgcatttatgcctctttaatggtcagcggggcaatcaatagattgcctgctacctggttaatcatgggtctgttatggggtggcaatgggcatgctggctgtgggatccatgtgctgagaaaaagaccattgaatgttgactgttacttttctttctctttccccagggcagccactgaagttttggcagcattgctgaaatccagtaagcacctcttttgaagggtggctatttctctccactctgggtttaatgaaagatactttctggtccccatggctgtttctttttttttttttttcatgaactactatttctcaatcacctatggctaattcctgaccttgaaagtgataaagtcatgtcgtgggtctttgggggtaagatagagaatattatggctgttccaggtacatgaccacaaagagaaaataaatattatccatacacaatgccaccaagacaatggaccctaaagggggtatattgactactgtggagctgatggaccctccacccctgtctaacagagccagcagtccctaaagattgttgaaataaattccaggttccagtgggattgcctccaggtcccagtggaagaaaagattttggctggctggagagaagtattcctgtatttggttctcaactcagctcagctcatgagtctatattcttgggcaggtggagtgctgggaattgcttggacaatgatgatgctgataacaaatttatatttaaaagttgactcttttctcagttacttgagtgattgcaaaagaatagctctggggttctgaataatttgaggaattttttgcctggtagccctggcctaattacgttgggagtcaatttcatgtgtgcaatataatagcaggcacaatgcacttgggagggaagaagtcttagcttaatgtttttactcattttttcctccttacctcttcatctattttaatttggcaccttggaagccagctgcttcaattgtgatatttgtttctctatagggagcctgaggcctgtgggtaataggtgaactttaataaaacttttaaataaataaataaaaataaaaacactctctccccccatccatacatctctgtcaactataagcagagagaaagagccaaatcacatgctgtttccctttataggcttagaaaaattgaagcttgaattcatttggtttatttgaatttgatatgagatgcaagtccacatctgtggacttgacatgagataagcttgataagctgtgatatgagataacttgagataacttgataagctgtgatatgagatccacagcttaaagacctgcaggtagagtggaggtggtaagagcaggataggggagtgaagaggaagggcttatgaagccctggagataggaagggatggaaaagtgttactgtgggttctggggagaggaccattcattcttcagactgaacttgcttcaggtttggcatctcggttctcattatttatctgctccctcggttgctcccaaatgcctggtgtttgaagcaccaaggtgagggggtgttgaattgcaggaggaaaagatgctgagagcagcctggtaggccagcctgtgaatgtcatgccttgggaaagaagctatctctcaaatccccccagcccagccttggcatggaggacttgatgtttcatgggaagggagcccagagagctgagtaaggctggcttactttctacatacacactttccttagctcttgagcttacggttgagcatcctgatataaattgtacctacctagatgtgtaaaactctgaaagtagtcttatgtcagttgtttactctattgatcaggaacacaatgcctcagcccaggaaaaaccaatagccagtgcaaacacggcttgattcaggctcagaccgtgtagctaggttttcaacacaccagccatgcctagtaggctgagtgtgcagtgatgggcctcagcttttagaatttctaacttcttctttccctttagagcttagctcagatattgcctcctctgaaaatcctttctctgactaccacaacttggatgcccctcaccaatgcttttataggctctcccaactcagacttgattacattgtgatgaaattgctattgtctgtctcttccagcagactgcaagcttttgagggagagagtcatctgtattggttgttgtattacttgcctcagcacaatgaaaatcctgaaataagtatttgttgactaaattttttttgttgttgttttctttttaaaataattttgagtactgggataccaaatttttaaatgaatacatgatttgtgatttttcccatgtgtaaaaatggcagtactgcc

SEQ ID NO: 1234 - DNA, 6113 bp, Homo sapiens
tcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaa

SEQ ID NO: 1235 - DNA, 14746 bp, Homo sapiens
aatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctataaattaggaaataattaccttaatccattaaatatagaaaaagataaacacattcaaaattaggtaaatgcacagcaaagtgacgagataccttttttcacctatcatcaactaggatcaataagtggataatatgtcaatgagggtgcaggggaaaagactttctcatacatatgctttttgtagaagcataatctggtacaaactatttggaaagtaattggtccatatttacaaaatttagaattcacatgcccttggatgagcaattttacttctaggaatataatctgcaattatgttcatatatatgcaaatatgtatgtctggaaaccacctaaatatccatcaatgacatattagtaaatgaattatggaacatctacaggatgttaaagcatggcatcattacaaagagtacattatatcaatatgtgctaagatggaaggatctcctccatatattgttaaatgaaagtatgctcccattgtgtgtacatagaatatttcaggaaggaatatctccctcctaggggagaaagactggtgatagaaagtgtggtgtaggaggaagacttccttttctctgatgcccttctttagtgtctacatttgttaatatggtttggtattactttttctacaaaataaattagttttaaaacatatgtcaagatttctgattccaaggggaaaaatcagataacatgagtttcctgttgtgatacagaatgggaaacgctacattaccaatgatgtacaccagccagaagtgcctgggggaatctaatcaagcctttagatttcacttccagttcagtgaaatcaagggatataggaacaaggtaaacaccacaatcaggtgaatcctatattctacaggctggctggcctggtcttttccacaggtcattgtgttggagttgctcatctttatatgacaaaccaatgcaatgcatggtcctggttgagacaaactggctataagaggtcttttgggaacaactgggcaaatttgactaaggaatcaggttaattttggcaatgcaggaaaatgttcttaatttctggaaataatgcaattttttaaaatgcatactaaatgttgattactatttataatttatgctaaatattttagaatataaaaaggaggcgtttttaaaaggcaagatttccacaggttttgattttgtagggggaaattaaggagaaggtaattgtctgccaaaaaaaaacagtgcaattaagaaaaactggcttgaactagctctttccagttctacagcagatgtttgctgtactggagttatcaagaagagcagatggccctctgataaaccctgctgtgcatagactcagcaatgcagaccagcaaatagctggcatggaaaccaactgaaagggatcgaagagatttgttgaaactaggggcgagggtcagctggaaaaacaattcctgctttgcaatgatca

SEQ ID NO: 1236 - DNA, 16475 bp, Homo sapiens
aatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctataaattaggaaataattaccttaatccattaaatatagaaaaagataaacacattcaaaattaggtaaatgcacagcaaagtgacgagataccttttttcacctatcatcaactaggatcaataagtggataatatgtcaatgagggtgcaggggaaaagactttctcatacatatgctttttgtagaagcataatctggtacaaactatttggaaagtaattggtccatatttacaaaatttagaattcacatgcccttggatgagcaattttacttctaggaatataatctgcaattatgttcatatatatgcaaatatgtatgtctggaaaccacctaaatatccatcaatgacatattagtaaatgaattatggaacatctacaggatgttaaagcatggcatcattacaaagagtacattatatcaatatgtgctaagatggaaggatctcctccatatattgttaaatgaaagtatgctcccattgtgtgtacatagaatatttcaggaaggaatatctccctcctaggggagaaagactggtgatagaaagtgtggtgtaggaggaagacttccttttctctgatgcccttctttagtgtctacatttgttaatatggtttggtattactttttctacaaaataaattagttttaaaacatatgtcaagatttctgattccaaggggaaaaatcagataacatgagtttcctgttgtgatacagaatgggaaacgctacattaccaatgatgtacaccagccagaagtgcctgggggaatctaatcaagcctttagatttcacttccagttcagtgaaatcaagggatataggaacaaggtaaacaccacaatcaggtgaatcctatattctacaggctggctggcctggtcttttccacaggtcattgtgttggagttgctcatctttatatgacaaaccaatgcaatgcatggtcctggttgagacaaactggctataagaggtcttttgggaacaactgggcaaatttgactaaggaatcaggttaattttggcaatgcaggaaaatgttcttaatttctggaaataatgcaattttttaaaatgcatactaaatgttgattactatttataatttatgctaaatattttagaatataaaaaggaggcgtttttaaaaggcaagatttccacaggttttgattttgtagggggaaattaaggagaaggtaattgtctgccaaaaaaaaacagtgcaattaagaaaaactggcttgaactagctctttccagttctacagcagatgtttgctgtactggagttatcaagaagagcagatggccctctgataaaccctgctgtgcatagactcagcaatgcagaccagcaaatagctggcatggaaaccaactgaaagggatcgaagagatttgttgaaactaggggcgagggtcagctggaaaaacaattcctgctttgcaatgatcacagccatgatttgatactttatgcaaaatcataaacaaagttaagcaactcactttggctgtacagtcagctgccttgaaggtgagcacatattttatttaatcagtaatgaaaatcctgaaaagagttgcagaagggtgcaattttgcctcatatcagtgttgttttgtgaaaggattttgagaaaagtagatggggcatgctagtggtgctattgctggcagtcacgtttcatttataacctccattatttatctggagcacagaggtgggaagaggagagaaagagaaataaaagttgtattttccatgatacaggtgcagatgagcccgcctttcaaaatagtgaagttggaggagaatcttttcatctggtggtggcaactcacctcgagggttctgtgctttcataactaatcatgttcaaccattttttaatttattcactcattcaatcactcattcattcactgttcaaataacatttatttagtgcttgactatgatagtcactcttatatgttccatagtaccctatatttatcattaataagttcaatgtagtttttgcttatttgttttggtttttttgtttgtttttgagacagagtctcactttgttgctcagactggagtgcagtggcaagatctcagctcactgcagcctccgcctcctgggttcaagtgattctcctgcctcagcctactgagtagctgggactacaggcgcccaccaccacatctggctaatttttgtatttttcatagagatgggtttcaccatgttggccaggctggtcttgaactcctgagctcaagcgatccacctaccttggactcccaaagtgttgggattacaggcatgacccaccatgcccggccagttcaatgtagttttaatactcccttggtcattcctgtttacttgcctattccctactcaacaggacagtgaaaacatcttgttagttgttgtattctcagcatccggcacattatagaactcaaaaaaaaattgttgaatgaatgaataagtaaatgaatgtacaaaccatgctaaggtcaaaggatgcaaagatgaataagccactctcttatgttgccttgctgaatcctcttgtcaaaagtattttgaagaacacgcacatggtgtaggacagaccagcatcagattgtgctcttttaaagaagctgaagttgaagagactggaaggaggaaatggggggcatcagaaagtgaaatggcaggctgtgcaaacagaatggctcagggggcaaccctgagaaggcccagaccagagtagatgaggaagcatttaggacagaggagagagttaggactcagggtcattagcaatagacaaaagtgcacattcaaaaatgcatcattggctgggcatggtggcttatgcctgtaatcctagcactttgggaggctgaagcatgtggatcacttgagctcaggagtttgagaccagcttgggcaacatggcaaaacctcatctccaccaaaaataggaaaaattagtggagtgtggtggcgtgtgcctgtggtcccaggtactcaggaggcttaggtgggaagatcgcttgagcccgagaggtggaggttgcagtgagccaagattgtaccactgtactccagcctggataacagagtgagactctgtctcaaaaaaaaaaaaaaaaaaaaaaattaaaatatgggaaccattttaatgtcttaaaa

SEQ ID NO: 1237 - DNA, 18115 bp, Homo sapiens
tccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaacttttattgctttgcaaggaagctttagtattaaatgtaagcattttcatctggtgattcttcccagtctcctgtggtaataatacctggacagggaagaaatcttttgagataactaaactatactgggaaatgggccccttgctaagtttcctgtggcagtgacaccccctctgttgcaaatattttctccgatgcgtggtttcagttccaagccaaacccgttctacagcgtgctttgtacctttccagagactgatcggtatcagcttgccagggctttaaaccccattcattctttcattacttaaaagcctctttctttggaaaacctttgagtgaagcataaaattagcatctaaaaagacatagcagcaactgaacccaggaacgtcagggaatatgtgaccaccagcaccattattgaccttcctaagtgcagtttgatgggggaaggggctatgcaggtggaaaaaggtggccgagaggtggaggtcccccggcaggggcagtcgcctctctggcctgagccagaaactcccaattctcatgggtggctgatgagagaacccctcccctcctttgtatttaatcctttctctaactcacttctaagctgacatcagaaaatctttgaagaaaagcacaggggaggcctatttcagtgactttcacttctctaaatgtttgttcttttcagttagttgtaaaatatgtttgaataatattttcaattctctttcaccactgttctacaaaatgtgagcctgtaggcattgttttttttaaatgaaaaagaaaagattgattttaggaatcacattcaaagtgtttgatgaatcagggctcagcttagcattcaagaacatggctgggaagtttccactttgttttcgccctagattcgtctttaaatcttttgtctcctatatttttccagctctgtggacttctttgaagagaagagggctatgaggattgaagaaagaaaggcttttatccagtaatttgtaatgatcccattggatgattatggaatattttttgtatacgtaacccctcagggaaaatctgagcctatctctacccttaaaaactctggtagcctgatggcgggtggcggggagagaagaaatcctgtttctcctttccctgattttgtccccaaactacatcttgctttgaaagtagaggagttggaaggagaggagttagtctctcatggggcccctggaaggcagatagctgccaatctttgtgtgcattttgtcaagaatggctgccttctaaaaacaaaccaactctcctcgatgcctcaggtcagggatctgggagagactggattgtataaaagatgtttccaaggcaaaaaagcattgctctcttggggcatttacagaggatgtcatcagtgggcacttggaagttctagaagtcatgtggggtgctggtgtctgcagttcctggtgtgctcaggacattctgtgtctgcatagagggttgctgccctatggctggccagctcatacctgcacaattacttccagcaccttggcaggcaggaaagggactacaaatataccaacagggtaggcgtttgctctggggaagaggctgatttggggtgaatagttcataccacaggaagcccgctgtgtgtggtgggcaggtgacatttggactgggctcctggtggcttttggctctcttccagtttggcctaacaatgaaattacacgttgaaggggtttgttactgttgatctttattccacagcctggcttcttggtaaaggcatccatgttgtccgtgtctacatttcctcatctcccattaattccccaccagcccacagtttgctttcagccttcacagctcctgggaaatgtctccccatctgttgccatcctggggcccctcccgaggcttagtctccttcctcttctgcccagagctcagccccttggctgctttgccacctccctcctctaaagtcacccactttgggagcttctcatttttctgtctcctttgccctttccttatgtttagttgttcccagactcctgggacttaagttcaaaccccaactctaccatttattaccactgaggcctgggcaggtcatataacttgcttcaaccttagattccttccctgtgaaatggggataatatagtacatacctcatgtgggggaagatgcaaagagacaatacttataaagtgatttacatggagcttcttatggggaaagtacttactagatgctagttaacatcactgttactcctttctcactctgcccactgtccacccactacagccagaggccttaacagcttccattctttgaaaggttgccctctagcctagcccttcctcctcagtctacaccccaggatgctgggtatctccagcaccataaatattgcagagcagtgagtaatacctgttgggttcactgaacccacttcataggccccactccctgtgctcagtgagcaataagtcctctcgtagattccacactgttaaatagaagaaataatgctgatcatggctgtgcactttgttcactatgcaaaggtacttgggagagcaccgctggctggagagtatatggtagctgggggacccaggaagaaggtctttctctatctcaagccttctttgaaattcagatatgttggaagacttcctagtgtctttcagggctgcgaagttacccaacaacctttaattgtgtgcattgctttttttttttttttttttttttttgagatggagtcttgctctgtcatccaggctggagtgcagtggcatgattttggctcactgcctccgtctcctggctggtctcaaaatcctgacctcaggtggtccacctgccttgacctcccaaagtgctgggattacaggtgtgggccaccacccccagcctgtgcattgctttctttctttttttttttttttttttaagacaaggtcttgctctgtcacccaggctggagtacaatggtgcaatcttggctcactgcaacctctgcctcccaggctcaagcgatcctcctacctcagtctcccaagtagctgggactacaggcacacaccaccacccccagctaatttttgtatttttgtagagacagaacttcaccatgttgcccaggctggtcttgaactcctgagttcaagcaatctgcctgcgttggcctcccaaagtgttgggattccaggtgtgagccaccacacccagattctaatatttttctataatgcgagatacaacctcccacccgtgattgtcgtgatataaatataaacatatttggtatggaacccaggcctgaaacctaggctcaccattattgtgtcaccttgtactgtgactgccacccctcgagctggcccctgccgcacaagtcacatgacctctgtgcagagggcagaatctgctggttcctcctgagtgtcaaactcctagtcccctgtctccttggggccagctcccttctttttgctgttgggactgaccgaccgcccatcacagcttccagcgctgctgctcagagcccctccccgtgctctaaggagctgcccctctcctggcattctcctctcttcccttcagtctccttgaagtgtggagaaagaggcaggcattttacagccatttacagccaggcacagtccttctagcccgttggagagaggcctgtctgtgaggaggggaggtctgtgacaaagattctctccttgaccaaactctagcccagcctcctctgagctgtttttcaatgaggctctctccttagacacatccttaaaatcccagttttagcaagaatcctgctaagtcagtttagcctcgatagtgggtcaccctccgtatctgatcaaatcctcgcccccaccatagccttggcctgccttcagcaagagccctcttagttgagtatagccagaatccccatggcctgatgtttcatctgaatcattttccatctgctgagcctcctgccctgctccatggctaacaactcccactttcccctatctctctgtcctgctgcaaaatcccattgcggtggtccctgtcactatcatgatagtcctgagtaaagtccgtcctttaacaagggtgagggccagttgtggtggctcacgcctgtaatcctagcactttgggaggcttaggcgggcggatcacctgatgtcaggagtttgaaaccagcctggccaacatggtgaaaccctgtctctactaaaaatacaaaaattagctgagtgtggtggtgcacgcctgtaatcccagctactaaggaggttgaggcaggagaattgcttgaacctgggaggtggaggttgcagtgagccgagattgcgccactgcactccagcctgggcgacagagggagactctacatcaaaaaaacaaacaaacaaacaaaaaaaccccaaaaaaccaaaaacaaaaacaacacaaaaacaagggtgagaataatcttttccttaacatgtgggtggaccactgctgcaggccatgtgagatgggaaagctgggggcccatatccagctttccctgctttcccattggggggctccatgtggatgtaacaacaggagaagctacaggcacgtcatgatttcccttgttctttgggaaatctgaaagaatgaatcctttcctaatcccagaaaggcagccaacctttgagaccttgagggtagactgcaaagttcacatctcacaggggtcaggtaggttatgtaaatttgtaaagtgttcccggtgctacgaaagggaggagtggagactgtggcaaagcagagaacacatgtcccatggaacgctgtcggtcggctccaaccagttacggcttctgggactgtgggcctggtcttgccagtgcacctgaagacaggaagctgggtttttacatgaaaattcgattttgtaaagtgttggcaagtagtaaaaatagagtatggtcaaaacaactcagaattttgccttcaggcatctggtttgtaatatctgggctagagtctcattatccctcttgttgagggagggaagttattaggaccgccagtgggaaggaaggaggctgctcactggcaggaagagggaagtggtgcaacctggagtcaaggtggatggcttaggtttaggcctttgggggatttccttggggcggggggtgggacggtgcactgtgtgcctgcagtgtcttcagtgggcacctgagttgcccctggagagctgccagccccacctgaaagcctggacttcttggctcagatcttcatgtgaggctcagccaggaagaaggggtgccacccacctttgtgaggccacatgagttatgccagcaaccccagatccataggaccttcctccagttggacttctgtggactgcacaggcccaggagttcctacatgagcccaaggggtgtggagagtgcaatccccaaaacatggctcagactggattatctgccaggtcggggactgagggccaagccatgtttaattgatttagaaaatgaagagatggaggccgggcatggtgtctcacacctgtagtcacagcactttgggaggctgaggtgggtggatcacgagtcaggagttcaagatcagcctggccaacatggtgaaaccccatctctactaaaatacaaaaattagccaggtgtggtggtgtgcgcctgtagtcccagctactcgagtggctgaggcgggagaattgcttgaacccacgagccagaggttgcagtgagctgagattgagccactgcactccagcctgggtgacagtcgcaagactccatctccaaaaaaaaaaaaaaaaaaaagagatgcaaaaatatcccaggtatcttcgtatgtcagtatatgtgtgtgtgtttagtatctcctgattgggacccagtttgaaagcctgagagttctggagatgtggatgcctgagaatcatggttttactaggcaaagattttctcctcttctcaaaatagctgtagctattagacatcctaagtatttaggttccatatcactttctccagttggggccggttttaggaaattgtccaggtgcctggtttccttgtacaaacaccttgctgacttacccactagtatcgaagccgctgagttttcatgactctgtcactgactttaatacttgcttttcccttgactgaacttcggatgtttaaatggaatttagtgacgttttcacaccacatttttcattatttagcactttggaaacagaggttgttttgttataagctttttattcttcttaacctcctctgaatacttgaaacctttcacgacggaaatgagtttactgtgacctgactcggtattatacaataaacgcatgattctcaaaacacgctgtttatatggagaataaacgcggtccggaacacagtgttcagtgtctgaaatgaaatgcaagtctcctgtttccaaaggctgacaggatggttgctgaatgatattccagctgctcaaatgaagggccctggaaaggtctgttggaagtgaattcgagggcgttgcctcttcgtggttgggtttgctctctgcagacccaggaaggccctactttccctgaattctgagcttcaaagcttacatctgtgtccttctgcttaacaacctgttttagcaaccaagtatgccaagatgttactgtcacattaaactgtgtacccctgcactctcctttcctttcctttcctttctcccctccctccctccctccttccttcctttttttttttttttccagtatctcactctgttgcccaggttggagtgtagtggcatgatctcagctcactgcaacctccacttcccgggtacaaataattctcatgtctcagcctcctgagtaactgggataacaggcatgtgctactatagcctggctaattttggtgttttagtagagatggggtttcaccatgttggccaggctggtctcgaactcctggcctcaagtgatctgcctgcctcggcctcccaaagtgctgggattacaggcatgagcgaccgcacccggcctgcgcttcctttcttgatcacaccaccacagtcttgacctgcaggtcaatctataccttatttgacatgaaatattgtcagcaagtctaatggaatattccaccagagtgggaaacccatctccaagatgcagtggtgagctattaattaaagctggctcgtgccctcagagcaactttctttgatgctgcttgtgacaggtcaacctttgcatcctatgcccagtggagcctgctctgcctggtgttatcatttgtcctttagggacggcgtggcctttttcttcatgtctgtgttagatgtcatccaagtgaattgcttctttctctttcctgtttatttgttatagggtgtcacctcttagccatctgagcactgggctggctgccaaaaacagaggtgatgatgtaacgtgccaactctcacatggctcagaggaggaggaccccaggactccaggatgggacagggcagccacttctcaccaaggtgacactggggcttctgagccagcctctgagtggggaatggggggaagggcaacatgatggaggggtcagtgacacacccccgtccccatgaagaaaggatttctactttgaaattcgtctactagaaactaattccttctgctcagttttcttcctcaggaaggggtgtgtgtgtgtgtgtgtgtgtgtgtgtgtgtgtgtgtgtgtattttgacagttctttctttttctttctttctttgagacggagtttcgctcttgttgcctaggctggagtgcaatggcacgatcttggctcactgcaacctccgcctcccaggttcaagcgattctcctgcctcggcctcccgagtagctgggattacaggcatgcggctaccacacccaactaattttgtatttttagtacagacagggtttctccatgttggtcaggctggtcttgaactcctgagctcaggtgatccacccgccttggcctcgaaagtgttgggattacaggcgtgagccaccgcacccggccaacagttctttcttcaaaagtgttacatattcattgtagaaaaatttaaaaactcacagaggcaataagtcattaagatcaatcaagaactatatacatataatcactattcaaacctgaggggtgtgtgtatctgtgtgcgtatgtttgtgcatttgcacacgtatgtgtagagacagaatttcatttctttttctttctttttttttttttgagatgaagtcttgctgtcgcccaggttggagtgcagtggcacgatctcggttcactgcaacctccctctgccttctgggttcaaccaattctgctgcctcagcctccggagtagctgggacgacaggcgcccaccaccacgccctgctgattttcatattttttgtagagatgcggtttcaccatattggccaggctggtctcgaactcctgacctcaggtgatctacccattttggcctcccaaagtgctgggattacaggcatgagccaccgcaccagtataaaaactggtatcatgtaatacacacattttcactactttaaaaaaatttgtcatgtggtgaagactttttctttccaataaatatcaatctatatcattattacatgggtctgtcaaaattggtttaaataaagaaataatttagtttccagatttatgcttgggtgaaggtgtttgaagttaatttgttttttcctctttttgagacagtctcgctctgtcatccaggctggagtgcactggtgctatcgtggctcactgcagccatgacctccttggttcaagtgatcctcccatctcagcctcctgagtagctggaattgcgggcatgtgccaccactcctggttaatttttttttttttttttttttgatattttttatagagacagggtttcaccatgttgccaggctggtcttgaattcttgggctcaagtgatcctcctgcctcagcctcccaaagtgctgggattacaggcgtgagacaacactcccggccccgggaaaaactttttacttcatgaagatgaaatattggacccaaatttctgtcttcagtgaggatttctttggagaatccttggccatatttagctttaattcaggcggtgctggactcacgactcagtgtgtgcattggagttctctctgcagtgctggctttctgaggaaagggtatgaccgcaaacattttttcaggatatcagaactgccttcctaccgaccctttggggctagcaagaagtgaagccatttggatgactattcagggcgctaaacagcctgtctgcttcatattgctaaaagaatccaacactcatcttttctcacctaggagctgcatacaatttcagcaactgcaagggatccagaccagctctaataatcaccacttctatatacctagtggttagaataggctcttttccaagtgctttatgcctattaatttatttactcctcatgaaagccctgagaggaaggtgctgtcactaaagcccacaccactgcgggaacacaggcatccagaggccaggcaactgtgaaactgcctttgcaaaattaagactaagacagtgagagagatctaacttaaccgactccatcttgcttctcacctccaagctgtccttgttcattcctgggcatagactgaactaactttgggaaatacttagtttatagtttatagtttaaaacaaagacgataacagccctttcccaaagctgacctccttcttgcctggggactagattgcctttgtaggactaacatcagccacaaggttagaaattatagtttaggagtcgtgcagctggaggctacaagattctgaccctccctaaactgctcctaagatcagtgcttgagatatttgcagaccctgcacttgatggatcagctggcaccaccccatcaataaactggctcacctgatcctgtggcccccacccaggaactgactcagcacgagacagctttgactccctgtgatttcacccctgaccaatcagcaccccggctcactggctttctcctgcccatcgaattgtccttagaaactctgctcccagcatgctcggggagactgatttgagtaataataaaactccagtctcctacacagtcggatttgcatgaattactctttgtctattgcagttcccctgtcttggtgaattggctcaatctaggcagcaggcaaggtgaaccccttgggtggtcacaactggcccataagtgcgaggctcatgagcagcgaagcaggccagccccccaggcagctggctctgaccactaacgctttcccatttcccgtagaactggtgtgcagccattagttcacacaagtcacatgaaagccctgtgtttccaaacgtgcagccgctccgcaccacaacaaatatcgtgttggtcggaaaacaatagctctcccctcagacacacagtgaaccttctcattctgaatatgtccatttcttcaataactacaagaggtatctgctatgtgccaggtgctgttctagaaacacattgatattctttttttttttttttttcttcagaagccagttggagtttatggtttcatttgcccaaaaatacgcctttggggacctcaaattctttccaagaatcactaccacacatattaatttgaacatttcccacccttccaccatccctgtttctcctgagagcttcaaaataaaaatggcctgtgtgcccccactccaggtcctcgtgcagggctctctcttcttctctggggactgcagttctgacgcagatgatggtgctgttccagtgctgggccattgcacaacacgagttttgtttccgggaatttttttttttttttgagagggagtcttgctctgtcgcccaggctggagtgcagtgatgcaatctcggcttactgcaacctccgcctcccaggttcaagcaattctcctgcctcagcctcccgcgtagctgggactacaggtgcaggctgccatgcctggctaactttttgtattttagtagagacagggtttcaccatgttgcccaggctgggcgcgaactcctgacctcaggtgatccgcccgccttggcctccaaagtgctacaggcatgagccaccgtgcccagcctccgggcggttttatagaaggctttagactgtgttcccagccctcggatttggacaccaagccacctcgcttctcacctcgc

SEQ ID NO: 1238 - DNA, 38236 bp, Homo sapiens
tccttatttaaaatagtgctcacattattctgctgagaattaccctctgatttcaatgcagctatatttatattaaattcttttagtatattctctattatttttcttgactcagtgtaggaaggggttatttctgcatatgctgattctgtcttcttgacattctgcattatgttttataattgaatattttaaggaagatattttaaaatttggtcatgtcactaattttttttcatgttatactgatgtaatgctgaacccctattaacctcaacagggatggcaacatgttcaagagactgaagaagagacccagagccagcaaacaggacatagggctttattagcaggaaacctacaaagagggagggccagtggcggcaggctggacaggagaaccacacagcccagtgagggggtgctgggctggagaaccatacggcccagaggcagcaggctgggcaggagaactgtaaccacttgcaaaaagcatgtagtttatatagcattttcactaagcaccctccccctaaccatcttcacctggcaaccttcacttaacccaaaacaaagggcctcaatcccctgtatggcctgtgtttcactagacaggccaggggctcagatgttcctcatagataaggaatgaatgcctgggttggccactcctggattcctcagcttggaactctgaacacacattcaggtgcctctgccatacagggccattctcaggttatggctaagttaaggtactgctatcaggtgcttctaccatacagtccaccccagctaccctggaacagctctcacatttttatcacgctattcttccatgatttccctggggccaggtaatgtggagaagcatcgctgccagactgctgcagcagcaatgcaaactaaaacaaaaaataatccaacttgggagttaattttggattcaccacagcaggcttatgatggaggagaggggcagctcttcacaggcccaacagtctgttttgttctggagagaggccaccatctgtgcccagttggtaaagagggtctgctgcacaccatctgtgggtggaagatgagatgtttagtgggtacaaggaagggcaataacagccgttcaacaagacacaggaagttgtattgttctgagaaagcgtcatccttggcagtggcctgggacctggctgacatcaccaaatggattggccccctctgggatgcattgcgggaggccagaataagacaatgggagtatcatgatgtttcataatgagaggatgatcatcccctttcacaagggaggaccaggattcattattttagaaatatgatggggagcagggcgcaaaataggtgtgacctgtgtatcttggtctaggcccttcccccatggagtggaaaaaccaaagcatcggggactggcttgccatttccaagaccacataatgatgtgctccccagtggacaggtcctgtggcaaggacaatcacaggttatcttgagtctcaggatgggacaaaggagtatcgtcccttaccttgtccacctggatcctgagagtggtatcacgttcttgcatcggaaggacataggcactggtgatgagaacgccatgttcattcagggtgcagacaactgctggtaaatggtgtgtccacagagccagagtgcgtctcctgctggagttgttgcttcaacagtccattcatcctttaaatcagccccacggctgcagggatgtacagcaggtggaaatgtcagtggatatccagggcctccacccattcctacactttatgtctggtaaagtgcaagccctggtcactattgatattggtggggacaccataggccacacacagccactctagtccttttatgatagttttctgggtagcatgcttgctgggatatgactgtggtagccctgtgcaggtgtccacataagtcaaggtatagtagcagccattagatagaaacaaatgccctatgtagtctacctgccaccattgtactggactctggccccaggggatctctccagtattgtgtggcaagggcctagggcattcctgtgcatgggtaggacattgctgacagaggtgtactatgtctttatgtcatagtggcaggccctaattcttcactgtggcccaaagggaatgctgtccccaaagtcctgtctttttgggcagccagtgggccacgtctgtggggactaccttgaagagatgaatgcaggctagcttgttctcatgttgatttccagatggcgtagatgcagtgtgggcatccacatggaagactgttacatgcattccctggatgtgacagagaatgtccttccacatgccagcaccccaaagcaggcagcctgctactgtccaatcctgagcttctccttgtggtagccacatagcaagtcccttaaagatggcccagctgttggtacacaagactattgggtccggctcatagaggaggatcgtctaggtggctctcagcttagcccatttgttactaagtcctaggcctgtatcaagccagatcctgtcagtggacagctggatggctgcagctgtccatgtgcaaggattgcctcatagcaagctctctgtgtaccagatctggtcaagaattgggccctgtccctcctgtacaaaggaggaaatctgtggaggttcagcggcctctttcaaagactgtctttcagatgttacataggtgacagtactgagcaccaaatggagctctgtgctcaaggggctattaatgaatgtgctcctttgttgaggtatgcatgccttttggctacagtctgtgtttgggcattcccaggctttagcttccggaaggtaccctttagtcaacctgctattggtactgggtgcgtactagcactaggacccactttgtaatgtcctccacttattgtaaagcatacatagcccagagttgtggcactccagctagctgaagcccccttccacagctgggaccagaatcctaaaggcacacatttatgcccttgccttcaccacaggccccacccaaacccctcagggtaactggctacgttcagttcacaaggctgcccctgcactacaagtcctaggcttgtatttgtttcactgcaactttagcttgttcaaaggcctcatcctcctttgtggaccagtcccagtgggcccccatcttgactagcagtatagggacctaaggagttgggccaaatgaggaataaaaggataccaacactgtaggaggcctaaggaagtttgcaagtgctttggtgtggtaggacatgggtaggcctacaccttatccataagagcagactgaaagaccttcgtcttacccaaccagatgacaaccagactgacaaacctggcctctggtctttgtatgcgttgactgccaatcctttgttcgccaagtgagagggtaaggtgggggctgtgcagattataagccagaaaaagacctaaaagttaatggaaaacatgtatcccctccagggtggtatccctgggcaagacagtccattgtttttcttcccatgtgaatgcaaattggtcttgactctctgagggcgatgggggatgccgaaggcattggctatcaatagccaaatggtatatgcccatggcttctcctacccttgtcccaagagaggtgatattgagaacagccacatacactggggggaccaccttacttaattcctagtaatctactgttattctttgtgtcccatcaggcttctgcatgggccattcagggctgttgtatgggctgtgcactggccttatagtgcctgcccaggctaactcccatatagtctctgtgatttcatcatgtccccacccttgcaggtggtattgctcagcacctctactcacggcagggctggaaagtgtcctggtgtccattttgcattctctgatcacagggttcaccacctaactctccgtcagaattcccctgcagttgtttgtggggtcaggcctgataagttatctactcccaagatgtattctgggatgggagcaaactataattagtctacaaaatgttgaccatttaaataaaaaattttctaatgtattagttgtaaaagtgcctcctatcacttcatatttttaattaatacacttagttttaatgtcttttatctgttctccatgtactctcaaaagtatctttttcaatgcgttccactggtttattttctctctgcctcactctttatctgttcattatttgtttatttatttatttatttattttgaggcggaatctcgttctgttgcctaggctggagtacagtggcacgatctcagctcactgcaccctctgcctcccgggtttaagtgattctcatgcctcagcctcccgagtagctgggactacaggggtgcaccaccatgctcagctaatttttgtatttttagtagagacggagtttctccatgttggccaagatggtcttgaactcctaacctcgtgatccatctgcctcagcctctcaaagtgctgggattacaggcatgagcctccgtgcccagcctgttcattatttattatatgaagtgtatagggtagtgattaagaccagcaaaagttctggagctattgactgcctgagtttgaatccatctgtgccacttactagctctgtttcccacgtgtacaatagaaatagtaataatatttaattcatagggttgttgtgagaattaaatgagttaatatatgtcaggtatttagaacagtaaataccttacagtaaggttctcaattatcttagcctgacagtaagttcccagttgttagccattttcatttttatataggctaattgagccaggcttctttcagttttcctcttctttcatttttcagactggcaccttagtacccagagttcagcagggaggccaggaaccttgttaggaagtagggagaggggagaagtctacaaatactcataatgtaatatccattcttttatctttgtcacatctaattataaaaacaaagacaaaagaataacttctgacttttacatgtaaacagatttagccctatattgcttccccctttcctcctgcttatccaactctcacatatatcctaagattttaatagtttttcttcaactgtgtaataatttttaagtgtgtttatttgattttagtgtttaccacatttcctttaatactgtaacccaaattatatctgaagtagtggcccatgagctgtaagggaaatgtttaaatagacagattttgagatttcaaacaaaatctccagacctgaattctttgatatcctcattcccaggagattgtgataaatgccaggtttgagaaccactgttttaaccaattgagaaatgaaacaaagtgaaaactcaagactggtgagggtagttggggagagtggtgatgtggttgaccattctttctctattagcttggaagatctatattctagctctcattctacatctctgactactttttcttcattttgtttgttccagtttttaaaaaacagatcccactttctcttaaataggttccccgccccccaacccggagtctattttggtcctctcttcctttgtttgctctcttagatcttaatattaactctcacttttctgcaagcctgttccccaagcctgttatacctcaagctctcaggaaaccgaggtcacattttcaacttgtctaaattctgtatctctgaaaacaaacccttcccctctcatctttctctttcattcattatgtattctctactcatcacctgggctccaccctcttctctttctactgcctctatcaaaattcatgctcatttctgttggaatgcactatagtgtcccctccaccttctgcctctttagtgcatcccggtatcagattaaccttcctaaaatattattccattatagtgtaatgattacacaatataaaaaaaaacttttaggttcgggggtacatgtgaggatatgttacataggtaaattcatgtcatgggagtttgttgtacagattatttcatcacccaggaattaagcccaatacccaatagtcatcttgctcctctccctcctcccaccctgcaccttcaggtacacccatgtctgtcatttctgtctttgcgttggtaagttctcttcatttagctcccaattgtgagaacaagccgtattctgtaacacaggttttctgttcctgcgttgtttgctaaggataatagcctgcagctccatccatattcccacaagacatgatctcattcttttttatggctgcatctgtcacacaattcttaagctcaaaatctttcaatgattgttcagtttatatagagttcagattattcagcttgatagccgagaacttccaaaaatatctcatgtactattattatatctcttattcctaatatttctctttactgccctaaactctatcaactggaaatgctccctaattaagggccctcatttcccctctctgtgttctcatccatttctctgcctagaatatgttttctgctttacttgtcctataaccttagcttttccttcaaagctcatttcaaatgccacttgctctaggaagttgtccctgagtaccataggtgcaaatggtgtcttcctttgaattctcatagattttatctgtcaagtgagtaaagacacttcacatttttttcatttattttcctgccgttattttaattttaaaatgtactgactacattaattcacacaattcaaacaagtaaaactatgcagagtgaagagtgggagttcttcagtgctttgccaaagccattcccatacctacaggaacacagcattactgtttagtatactatatccttctaagtcagtagttctcaaaatgttcctggtaaactccttgcttcaaaccacctggggagctagttaaaaatggaggtgcctgtgcatcaacccagcccttccgaattggaatctcttggaagtaggaactaggaagctgcactttggtcattcttaatcatactaaattttgagaatcatcccttttatctatgcattaaataagagttcttttacaaatgtataattttgtttttttgtttggttgttatgttccttcagtaatgctattggctttcttttcatttttagcaatgcatctcagagatattcataaaacaaatgtagagacgcactgtgtgtgtgtgctttttaaaaaatttttaaactctatagaatacatttaccaagattgatatagctatttttctgttgatggacatttaggctttccagtttttaattattaagaacagtgcttcagtgaatgtgtaaaatttgcacacatggtgataagtttatggagtagaagttgctgggttaagtgcatattcaaaatgcttatgctgctaaattgttctccaaacaggctttttgggttcataccaaatttccaccaattgtgaaagagaatattcatatccccacaactgtaatcagtagtacatcttatttttcagtttttcaggctggtggatgaaaaatagtatttccttgttgttttaatttgctcattttttcatgactggtgaggttgagctcctgattttcttttttgccatttgtatttccttttacatgaactgtcagttctcatttttgttcatggttattatttattgaattgtctaccatcagtgctattgaactgtccattatttgtctactgatttgaaatgtcatgtttgtcatactaacttcctataagtacattgaacagtttctgaactttttattctcttcttttaatgtatttgcatttatctcctatcatttatattatggtagctttgtagtttgcttttccttctttcttttttttttttttttttttttttttgagacagtgtatcactctgttgccctggctagagtacagtggtgcgatcttggctcactgcagcctccgcctcccgggttcaagcgattcccctgcttcagcctcctgagcagctgggactacaggcatgcgccaccatgccgagctaatttttgtatttatagtagagatggggtttcaccatattggccaggctggtctcgaactcctgacctcgtgatccgcccacctcagcctcccaaagtgctgggattacaggcgtgagccactgcacccggctttttctttcttttttaattttagagacagagtctcactctgttccccacgctggagtgcagcagcatgattatggctcacggcatccctgatctcacaggctccagaccacaggttcatgccatcatgcccagctaattatttatttttggtagatatggcatctttctatgtcgcccaggctggtctcaaactgggactcgaggggccctcccaccttggccttccaatgtgctgggattacaggtatgaaccactgtacctggcccatagtctgcttttatatcatcacctttattctttttcaaaaaatttcttggttatccctgtccattttttctttcatatgaaattttaattagcttataaaatccatacaaaattgtatttgaattttgattgagactgcaatgagttctaggttaatttggggaagatttgacaattttccaaatcttgatatctccccaaagcacagacatatttttgatgtttagtcttctcatcaggaagctggcagtctctgcagtcttctgttctttagtaaagttttagtattttctttaaataggtctcaaaactttttaaatattttgcttattgataagtatttttataattgttttgtttttgcaaacttgaataggattttttccattatatttgctaattggtttttgctgatttttaggaaaactgttgaagtttcttgcagttctagtagtttttcagccatttcatttacacttttcagtcaatgatgccatctatagataatgagtcttgtctcttcctttccagttattgtaccccatttatttatcttatcttactgaattagctaagtctgttggctcaacattgaacagtcatggtgagattgggcaccatgattcttctgtctttaatgaaaggctactagtgtttgttaatcaaatatgaggttttctataggtttgtggtagatgtcttttgtgatgttaaggaagatttcttctattaatctgagttaaagcttattatatggaagtgttaaataaatgctttttccagaatccagatgatcatttgagttttctctttaacttatatgttaatttggtggatatagcgacttacattattacttacctgaattcactcttggaaggaaaagaatcctcttgggtagtaatgaattgtgtcatattacttttatgtgatttcttagtattttatttagttgtatgacattaagttgtaagtgaaattagcctgtgaataggcagactaatggcctcacaaagatgtcctaattcgtgaaacctgtgaataagctactttacatagcaaaagggatgttgcacatatgagttaggttaacaaatttgtgctaaagagattattctagattatctacattggcccaatcaaattgcacaagtccttaaaaagggaaaacctttccagctgcaactagagaaagagatgtagcaacagaggagagttcacagagatgtgatgtgagaaggacttgtgctgactttactggatttgaagacagaggaagtgtactatgagccaagaaatggaggcagcctctattagaaaagacaaggaagtagattctcccctagagcatctagaaaagaatgcagctttgttgatgccttgattttagctcatggagacccactttggacttctgacctacagaactgtaagataatagatttgtgttgtgttaagccgggaaagtttgttagagtggcaatagaaaattaacatagcctatggtttcatctgtgtgctctccaagtttagaaacaaaactgtagctgaaaagttttctttttcaatgctttaaaacagacttcaaaaaaatcatttaagtttgataaaattaagctgttaaacctggctcttgtgcctttttaaaggagaaaatatttgattcttcaatttcttttgtgacatcttttcctaaacatgtgttataattctcaagtatatattttgtcttccccactagactggaagcttcttgaaggcataatgtgtctgattaatcttgctatctaacttagtacctaaaataatcccttacagtaatgcaaacatttatatagatatcttattcaactttgcatcctcatagcactatatacagtgtctaatgtttatgaaactaatttcaaaaatgtatggtaatttagacagcttaattgattaggtaattcagataatatgctgagtgaacatgagctttgaagtcaggcctgagttaaatcctggatgaaccactttcctaactctgtaaatttagacagttgattaacatctcaaagattcactttcctcactagtaaaatggtaagtaaaatcctcacttattttatagtgaggaaatgtttgtagagtgcttagcacaatactggataggcaatcgtcgctttatgttagtaagttatgaagataaaaaatgttatttagaatcaaatggtattttataaaaatgttactttttctgttgctcctgttgtaattttttaggctgttgtcatgtcaaaaggggatactaagtttccaatctgttcttgagtatacagtaatgcggtcaataactttagttggtgcctccaacaagtattatccgtggatgaggttacatctgggtactttggaatatgatagaagcaacatctggtgtgcttttatacagctcatgaagtcagtgctttagaaactgaattaaaatgtttcaagggttttcttcctatttaatgctgtgatgttgctaatcccgtcctcctcttaaagctggtgatcctcctcacattaacggccattgatatagtttggataattgtcctcactcaaatctcatgttgaaatgtaatcctcagtgttagaggtggggccttgtgggaggtgtttgggttatgggagtggattcctcatggcttggtgccttcctctgggtagcgagttcattttcacgagatctggttgttcaaagtgcatggcacctcccctactctcccttgctcctgccttcagcatgtgaagtgcctgctcctgctttgccttctgccacaagtaaaagcttcctgaggcctctccagaagcagatgccagcactatgcttcctgtacagcctgcagaagcatgagccaattaaacctcttttcttataaattacccagtcttgagtatagcaatgcaagagtggcctaacacagccatccttgatatttatggaaccctctcaggcttaatagttgactcaagcacaatgaataagtggtcccctgtctttgtgaattcatagataaaaagacaagacaatcttgtgttgtgacttgttttgtagtttccattgaaatcttgtagggtaggttgtagtgaagtgtgtatcttacatcattttctgggaattcatagggaagaaaaattgaagataagaaaatttaacactgattttcttgctcaatatggttctaaggagttgatatcagattttgaattgggtggtgatggtggagatgaaacagtgaatgtgtgcagaccaggcaagactgaatgaagagaaggaatggggctataaaagacactttgccaaaataaataatagtcactatatgtcatatccctactatgtgacaagattgttatctgctttatagacatcattttcaaacctatcgataaccttgcaaagtgaattttttggataaacaggccctgaggagaactttgccccagtaagttttcatagggttggtgatgcaaatctttctggatacaaaagccagtggaaagtagtacaaatcacgtatcccttatacgaataaagaaactgctggagtaccacttctctcctggggttgaagagatcatttaggtaaatactccttttaaagatgtaaaagctaatgatggtttacaaacttaaattcttacactagcaaggagtgggagctggccattggagagagagtactgacggacgtggtaagaaagtaggatttcaggtttagatataattcattttaatgaatgtgtgggaatacacagaagagaaattatatggctccaggttacttagtattgatctaagcttcagtttatacaaaccaatttagactttcctgaagtataaattgagttatatcttaattatgagaacatattaataaactaattaatataaacaggactagactaccccaaaagattcataaactaagcagcagcagtggccctgtatcatcacagttgcattttggaaggtaaaattaaccatttggaaatatgtattccatcaccttctttatgcaaggtacttatttaggctgaagacacaggacagaaaagggctttgcccatatatacagatgaacatggacaaagataaacttcagataattagagctatgcagagactttatggtattgtgaagagacaattttcgattatgtgtaataggaaggtgtcccagaggatgtggcatttaagcagagatttgaataacaaaaacaaactagccatggaaataaaatgtaggaggaagaaattctaggcagagggagtagctagtgcaaaggtggtcacatgatgtgtgtgggtgtgtgtgtttccccctaggactctaacacagaaggtgaaggagagaatggtgggaagttgcattggagaggtacggaggggctgcatcatttacatttggcccctttatgataaggggtatccatattaaagtaaattgcctctagatgggttaagaacagtgtgtcataaaagtcaagtgaacaggtttcatttatatgtaccaccagatgctgcagtgcaagaatgttttctgtaatgtttgtttttattttttgccttgtattaatgctagtgtatttaagtttccactgtcagcccctgaagagcagagcagacatctgctccttctagtacctaatccagtgccatagcacagaaattctcaactagtgaatcaatattgattggtgtagactagttaactatgttattgccacaaatgacatctaacctgagctagttatcccacaaatagtcctcacagttatgaaaagggaaccacagtgtgtgatgttccccttcctgtgtccatgtgtccatgtgttctcattgttcaattcccacctatgagtgagaatatgtggtgtttggttttttgtcctttcaatagtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgtcttccacaatggttgaactagtttacagtcccaccaacggtgtaaaattgttcctatttctccacatcctctccagcacctgttgtttcctgactttttaatgatcaccattctaactggtatgagatggtatctcattgtggttttgatttgcatttctctgatggccagtgatgatgagcattttctcatgtgtcttttggctgcataaatgtcttcttttgagaagtgtctgttcatatccttcgcccactttttgatggggttgtttttttcttgtaaatttgtttgagttctttgtagattctggatattatccctttgtcagatgagtatattgcaaaaattttctcccattctgtaggtagtctgttcactctgatggtagtttcttttgctgtgcagaagctctttagtttaattagatcccatttgtcaattttggcttttgttgccattgcttttggtattttagacatgaagtccttgcctatgtcctaaatggtattgcctaggttttcttctagagtttttatggttttaggtctaacatttaaatctttaatccatcttgaattaatttttgtataaggtgtaaggaagggatccagtttcagctttccacatatggctagccagttttcccagcaccatttattaaatagggaatcctttccccatttcttgtctttgtcaggtttgtcaaagatcagatagttgtagatatgtggcattatttctgagggctctgttctgttccattagtctatatctctgtttttgtaccagtaccatgctgttttggttactgtagccttgtagtatagtttgaagtcaggtagcatgatgcctccagccttgttcttttggcttaggattgacttggcaatgtgggctcttttttggttccatatgaactttaaagtagctttttccaattctgtgaagaaagtcattggtagcttgacggggatggcatcaaatctataaattaccttgggcagtatggccattttcacaatattgattcttcctacccatgagcatggaatgttcttccatttgtttgtatcttttatttcattgagcagtggtttgtagctctccttgaagaggtccttcacatcccttgtaagttggattcctaggtattttattctctttgaagcaattgtgaatgggagttcactcatgatttggctgtttgtctgttattggtgtataagaatgcttgtgattttgcacattgattttgtatcctgagactttgctgaagttgtttatcagcttaaggagattttgggctgagacaatggggttttctagatatacaatcatgtcatctgcaaacagggacaatttgacttcctcttttcctaagtgaataccctttctttctcctgcctgattgccccggtcagaacttccaacactatgttgaataggagtggtgagagagggtatccgtgtcttgtgccagttttcaaagggaatgcttccagtttttgcccattcagtatgatattggctgtgggtttgtcataaatagctcttattattttgagatacatcccatcagaagggatagcattagtagatatacctaatgttaaatgacgagttaatgcatgcagcacaccaacatggcacatgtatatatatgtaacaaacctgcacgttgtgcacatgtaccctaaaacttaaggtataataataataataataaaaagaaaataataaataaaaagggaaccacaaggcctactagatcagtgaaaattcatttactcaagacaactccaagtacataatgtcttaggtaatactctatataaagtggtttgtcacaagagctgtgcttgctttcttttgaattttatgcttcacattctgtgggaaaatgtattacacagtatctcacagaagtattactattaacctatatttacttataatactatcttctatagcgtgatgttaaaatttgataaattttagggaggaaaatgtttgtctttctttttttctcagacaagctcttagtctgttgcccaggctggagtccgttggtctaatcttggctcactgcaacctccgcctcccaggctcagatgatctttgtgcctcagcctcccgagtagcgaggactacaagtgcatgccactgcgcctggctgatttttaaaatttttgtgtacagatgatgtctcactatattgccaggctggtcttgagctcctgggctcaagcgatccgcctaccttggcatctcaaagtgctgggattacaggtgtgagctaccacacccagcctgttcattttattataaataatttgttggaactttctcagttatagaattgatgttagcagttcatttaaccgtaagactaaagggatggtttgtgacatcctgactcccattctgtatctcttcattccaactggcaccattccctaggcccacagggtcttccccactgccctcccctccccccacctgccctcaccttttctggtcacaagctccagaccattccactttcctatcaaaatatgtcttcttacttccaaattcccaagtccctgttctacttccaacacactgtactccagtactttaatccgtggtaatgattcagtggagccagagaatataaagctcattatacagttagttaagctgttaggccctctttctgtcttaagcatctttcttcttgcagacagtctcaaagatttttccttcttccagtaatcacccatttatttccaaggaatgtttcatccatgcctagctttaggaaacatgttattgcttggatttctattgaaaatatgtgtggcaatttggaaaccattttttcctgacttcattattctttcatgttttagcctgtcaatgcaaactctattatccagagatgcattatagaacaggagtttaagggagaaggaaattaatattggccatggtcatgttcgtattctttttccttgtagaagacaacaggcatagctagagtggcattagctaactgtaaaaaggatttgtagggctagggatgaatgtaaatgtaaacaacttaaatgtggattctattatagcttcacatagagtatctgtgaccacaaatcatattcttctcagtagctgatttcccacaccagttcaaagggctacagaagaaatactgtcatcaggacactacgaatagtttacttggatatatgcaataaaaggatgcaagtatattttctcgcattttcttcctaaagagttgcaaacagggctggatctagaaaatactgtttcctttttttggggtaatgctccctgccatttttatggtttacatgggcattccaatccatcaatagatttgttttacagctttcaaattattaatgacaaattcaagaaacaattctgcagtcaatgcctatggtctaattttttgtagttttcctttaacttaaaaaccatagaaagaagtaccatctttgatactactgatgggcccaaacttaaaaatttatgatgcaaaatagttttagctatcatttatgattactaaaaacaaccattgacaataaatattttatactatcacaaaaagcagactagctttctcataacttagcaaaggtgttatggttgaaaataaaattcaaaataagttgaactgcttaactcataattactaaaagttcatactctatagtgccatatgtaacaagattctcatttaaaaaaatagatgcatactaatttagaaactactgagatggttattttccttttttgagacctagctgtcacccaggctggagtgcagtggtgtgatctcagctcactgcaacctccgccttccaggttcgtgcgattcttgtgcctcagcttcctgagtagctgggattacagtcacatgctgccatgcctggctacgttttgtatttttagtagacatggagtttcatcatgttggctaagctgatctcgaactcttgacctcaagcaatccacccacctcggcctcccaaactgttgggattacaggcatgagccacccagaaaactactgagattctgaaacaaatttagaaaaaagcatacaaaccaaagtttaaggtacatttaaaaggctttccaattgttgagatttccatttctctgccaagagaaaaacagggtttagaaaaaccagcgtatctccttttacgcatttagagatctttaaattgttagctattgtagcctgcttgttcactgggttttgtagtgtgtatatatataggccaccactaatatacttcgggagctttgcattcacagtagctcatggatatgactttaacatgaattatcatactatcatggttatggcaattcagttttttttaagaataaagttattataatacaaacattccttgtagtaaatgtttgtattatgggttttttttttttttttgtaacaaagaatttgttttctacctttgttatcatttaacaagcaatttacaaaaccaagaaggaaccaaatctttgatttacatttctgctgacctagtgtgtggactcttgcagaggaatagcattgctgcatagtgctcagaaagtgtgggaaaacggaacaaaaagcttgaatccatttttttttctgcttttacatcagaatttatatttaggttatactttcctagaggaatgaacaatacatctctcttatccacaatgtgtaatttgctagttttgtgtttaaagcttttcttatttcctgttctacttctgtgaattaaggattttaagcaggggcaaaactgtagcatcagcaggtaatcattcttggatacagatactaagtacatgtagcatgcttgtcttcactcttaggtcataagctccatgagagcaggggacaatgatcactccaatccttgctgctttcccagcatatagcacatggcagaattcaaacatttgtttaataaacaacaacaacaaaaaacctttcatatcatgaggaagacatctgctgtcctgaaagagctgataaattatgtagcttacttaaaaaaaaaaaaagaatatgatatggttgacatacaataaagtagaatttatgctgttgccctgcttctgccataaacatgacaaaacatgacaatgggaagtcacctgagttctctggatctcagtgaataaatttatgacattaagggatttaacaaaaatgaaacccagtgggaaaattgtacaagtcactcaagttctaaattgcttcccaatgctgaaatcacttagtgagatacatcaaagaccacagaactttcggtttacaagtaacagacaaagaatactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgta

SEQ ID NO: 1239 - DNA, 44264 bp, Homo sapiens
ttgtttcagtaagtagggaaagagttacatcattcagtctacaccttagaatcatctggcccagaccagttagagtttctgaaattagccttgggtgtgtgtgtgtgtgtgtgtgtgtgtgtgtgtgtgtgtgtgttttaaagcctccctcttttccagtgattctaatgtaaagcacagcttgaaaactactaagttattacctccattagtgcagtggttcttcaggtatggtccccagacaagctgcattaacatcacctgggacctagttagaaatggaaattataaggccctatccccagacctactgaatcaggaactctaagggtagagccgagattttgggattcggttcagatgtgtgtatcagaagactcaacagtgtcttaattgcagtttatttctctgtcttgtaaaaacggtctagaagtaggtgttccagagcagacatcgtcctccttggtgttagagatcctgattccttctttttttctaccctaccattctcaggatgtggcttcctcttcataggccaagatggctgcctgatttccagctatgacttctgaattccagtcagcaagtaggaaatgcacttccccccacccttactttgacacttcttggaagccgtatgacacatcagcttatatcacattgactagtatttagtatttatagagtctgcaaaaggtggtaatttcgggggcggccatgtgcccacctaaaatcagggttctctttcagagaaaggagaataaatattggatgacagcaagcagtatttgccagagttaactaattgctttttttctacctccaaaattctaaagtgagataataagcatcataactgtttgaacacttttggtttgctgttctaagtgatgctccttatttcattagtcttttcactgtattaatgatggcaagtatttattcatatggctgaactatgattaattcttcccctaattttgaatatttggaatgttacaatttttgctgttgaaagtgctgcactagggcttattgcatttgtgatgtactgcatttctgattatcacttcggaacgtagattcctagataggttaaagaatttgaacatcgttaaggctctttattcatatggctgattttcttgcaagaagggaaacgttttgtgctccattataagtgaactacatttttggcagcaaaaagttttgtcttcttaaactttttgttctttcaacattttgaaaatagtgcattactatcttcttgcaacctaatgatgctgctgagaaatctgatatcaatttgatttgcattcctttggaggtaatctgacctttctctcttagcttttagaaaattgtctttatcctaaatgttctgaaattctaccatattgaagtgtaagaagaccctatatttttatttagcagttcttttttattgaaggattgtaatcattcttaaattctgaaaaaaatattgaccatagatttttccagtattttctttcttccatcttctctgttctcttacttagaactcctatttgttgaaactgtatctaaacttcctttctcttttatattttggatctcttggccagctgtggtgactcacacctgtaatcccagcaccttgggaggccgaggcgggcacatcacctgaggtcaggagttcaagaccagcctggccaatgtggtgaaaccccgtgtctactaaaaatacaaaaattagctgggcgtggtggcaggtgcctgtaatcccagctcctcagaaggctgaggcaggagaattgcttgaacccggaaggcagaggttgcagtgagcggagattgtgccattgcactccagcctgggtgacaagcgtgagactctgtcacaaaaaaaagaaaacatttatatatatatataatttatgtatatcatatatataatttatatcatatataatatcatatattgatatatatgatataaaagaaaggaagtttaaatacagtttcaacaaataggagttctaagtaagagaatagagaagatggaagaaaaaatactggaaaaatctatggtcaatatttttttcagaatttaagaatgattacaatccttcaataaaaaagaactgctaaataaaaatatagggtcttcttacacttaatatataatattaatatcatattatgcttaatatacaatattatatataatataatctttaatataattaatatatatgttatataatatataatatatatcattatatataatacataatatatatcattatatataatatataatatatcattatatataatatattatatgttacatataatatataatatatcattatatatatcagttatatattatatataatatatcattatatataatatatcatatatcatgttatataatatgtataatatatcatatatcatgatatattatatatgatatattatatatcatatatcattatataatataatatatattatatataatgtatcattatataatataatatatcatatataatatatcatatataatatatcatatataatatatcattatatataatatatcatatataatatatcattatatataatatatcatatataatatatcattatatataatatatcatatataatatatcattatatataatatatcatatatcatatatcatgtaatataatatgtaatatatatcatgtaatataatatatatcatgtaatatataatatatatcatgtaatataatatattatatatcatgtaatataatatatatcatgtaatataatatatatcatgtaatataatatattatatatcatgtaatataatatattatatatcatgtaatataatatattatatatcatgtaatataatatataatatagtatatactgtaatataatatataatatattatatactatatactatataatatatactatatataatatatattatatactatataatatatagtatatactatatattatatactatatataatatatattatatactatatactatatataatatatattacatactatatactatatattatatattatatactatatataatatatactatacataatataatgatatacaatatataacatatgtattatacaattatatattttatatataaatatatattattaattattaatatattaaatatatattatatataatattatataaatatataatataattatataaatatataattatataaatatatataatataattatataaatatatataatataattatataaatttatataattatataaatatataatataattatataaatatataatataattatataaataaatataattatataaatatataatataattatataaatatataatataattatataaatatatataatataattatataaatatataattatattatatatataatataattatataaatatataattatattatatatataatataattatataaatatataattatataaatatataatataattatataaatatataattatataaatatacataatataattatataaatatataattatataaatatatataatataattatataaatatataattatataaagatatataagataattatataaatatataattatataaagatatataagataattatataaatatataattatataaagatatataagataattatataaatatataatataattatataaagatatataagataattatataaagatatataatataattatataaagatataatataattatataaagatatataatataattatataaatatataatataattatataaagatatataatataattatataaatatataatataattatataaatatataatataattatattgtatataatataattatataaagatatataatataattatataaatatataatataattatataaatatataatataattatgtaaatatatataatataatttataaatatataatataattatataaatatatataatataatttataaatatataatataattatataaatatataatataattatatataatctctttatatatatttatatattatatataatctctttatatatttattatatataattatatcatattatatatataattttatttctttggaagaattcctcaatgttgcagccaccaattttcttctcaagctgttgtcaaccaacaagaggctaaagaccagactacaatgcaataaatcagggaatttattggagtcctagaaattgcaatttaagagtcacagattcagctggaagccaaactgtgttgtgaagagaggtggagaatagggggttttaagaaaaaatcaaaaagaagctaagggtgattacataagttgtgttgaaagaattatcattggtgaagggggtggcttagtacaggagtccgtagttctttgattgttactgtcaacataagaatcttgagatcttaactttggagaggagactttcttgtaaagggttacagcctaccaggctggccattctgcagcctgggaagtacagcctctagcagagaccattagcaggcacttctaggaagggaaggatgagatagaaatttattctgaacaggttggctaaatatacatattcattagcttataagaggacttatgaatattcacaaagtggggatgtacacgtgtgtgataagcaagcatgcatgttacatgcattccatgttcactttgggacagagatttaacattgaaatgtattacagttaggccctatatgtcaaaaggtgaagtagggacacaaagacactcaagttcacagcctctgtaaatcagccatcaccagtccatagtctgtggtcttttatccatgaaagttactgatataggtctcttgtccaattaaagctgtaggtatggcttgtggaagaggggatgagttagcattggtggtggatgagctgcaattgttttaatattgcttatctcaaggccagcacttgttttgctgatagaggaaaagaagaagcaattagaacatagtttattcttaaaatgtaggcatacataacttaacccttgcctggcatgacattaggtctatttataatttggtatcttcttactacaaagagtccattctgtcagtcttatgagctctattttaacattagacaactgaccagcattaagctgcagaagggagggggtacaatgaggcatgtctgacctcccatcccttcatggcctggaactcagtttttaaggtttctctgaagtccccttggccaagaagggtctgtttggttggctggggggcttaggattttatttttagtttttattgctcaggaattaaattcagctgttttccaggctgctgtggacatggaagtttggctcagctcaaaggtacaagacaagtttctgggtttgtttggttttttcttccttcaagtctacgggatatgcaggcagtccttcttagaatggcttcccaattccatttgagagcttgaaccagagtgacaccattttgcgtatcacctttcacactatcattttaaaattttcccaggtcacttgtttcatttcttgaaatgtccattagcctgttatgatctcctgtttcttgtttggtggcatttaccatctttatcttttcaggatattaaatatacatgttttaagccctgttctgaatactcattttactgtttcatcagcttgtaaattattctgtttgttggatctgtcatctctctttcgtggtgttgactatctccagatgttaggagtatcttgcttttccatagtagcttttctgctgtgatctctgatgcttcttgctttaatgtcttgcagagactgagttttccttactttccttatttaaaatagtgctcacattattctgctgagaattaccctctgatttcaatgcagctatatttatattaaattcttttagtatattctctattatttttcttgactcagtgtaggaaggggttatttctgcatatgctgattctgtcttcttgacattctgcattatgttttataattgaatattttaaggaagatattttaaaatttggtcatgtcactaattttttttcatgttatactgatgtaatgctgaacccctattaacctcaacagggatggcaacatgttcaagagactgaagaagagacccagagccagcaaacaggacatagggctttattagcaggaaacctacaaagagggagggccagtggcggcaggctggacaggagaaccacacagcccagtgagggggtgctgggctggagaaccatacggcccagaggcagcaggctgggcaggagaactgtaaccacttgcaaaaagcatgtagtttatatagcattttcactaagcaccctccccctaaccatcttcacctggcaaccttcacttaacccaaaacaaagggcctcaatcccctgtatggcctgtgtttcactagacaggccaggggctcagatgttcctcatagataaggaatgaatgcctgggttggccactcctggattcctcagcttggaactctgaacacacattcaggtgcctctgccatacagggccattctcaggttatggctaagttaaggtactgctatcaggtgcttctaccatacagtccaccccagctaccctggaacagctctcacatttttatcacgctattcttccatgatttccctggggccaggtaatgtggagaagcatcgctgccagactgctgcagcagcaatgcaaactaaaacaaaaaataatccaacttgggagttaattttggattcaccacagcaggcttatgatggaggagaggggcagctcttcacaggcccaacagtctgttttgttctggagagaggccaccatctgtgcccagttggtaaagagggtctgctgcacaccatctgtgggtggaagatgagatgtttagtgggtacaaggaagggcaataacagccgttcaacaagacacaggaagttgtattgttctgagaaagcgtcatccttggcagtggcctgggacctggctgacatcaccaaatggattggccccctctgggatgcattgcgggaggccagaataagacaatgggagtatcatgatgtttcataatgagaggatgatcatcccctttcacaagggaggaccaggattcattattttagaaatatgatggggagcagggcgcaaaataggtgtgacctgtgtatcttggtctaggcccttcccccatggagtggaaaaaccaaagcatcggggactggcttgccatttccaagaccacataatgatgtgctccccagtggacaggtcctgtggcaaggacaatcacaggttatcttgagtctcaggatgggacaaaggagtatcgtcccttaccttgtccacctggatcctgagagtggtatcacgttcttgcatcggaaggacataggcactggtgatgagaacgccatgttcattcagggtgcagacaactgctggtaaatggtgtgtccacagagccagagtgcgtctcctgctggagttgttgcttcaacagtccattcatcctttaaatcagccccacggctgcagggatgtacagcaggtggaaatgtcagtggatatccagggcctccacccattcctacactttatgtctggtaaagtgcaagccctggtcactattgatattggtggggacaccataggccacacacagccactctagtccttttatgatagttttctgggtagcatgcttgctgggatatgactgtggtagccctgtgcaggtgtccacataagtcaaggtatagtagcagccattagatagaaacaaatgccctatgtagtctacctgccaccattgtactggactctggccccaggggatctctccagtattgtgtggcaagggcctagggcattcctgtgcatgggtaggacattgctgacagaggtgtactatgtctttatgtcatagtggcaggccctaattcttcactgtggcccaaagggaatgctgtccccaaagtcctgtctttttgggcagccagtgggccacgtctgtggggactaccttgaagagatgaatgcaggctagcttgttctcatgttgatttccagatggcgtagatgcagtgtgggcatccacatggaagactgttacatgcattccctggatgtgacagagaatgtccttccacatgccagcaccccaaagcaggcagcctgctactgtccaatcctgagcttctccttgtggtagccacatagcaagtcccttaaagatggcccagctgttggtacacaagactattgggtccggctcatagaggaggatcgtctaggtggctctcagcttagcccatttgttactaagtcctaggcctgtatcaagccagatcctgtcagtggacagctggatggctgcagctgtccatgtgcaaggattgcctcatagcaagctctctgtgtaccagatctggtcaagaattgggccctgtccctcctgtacaaaggaggaaatctgtggaggttcagcggcctctttcaaagactgtctttcagatgttacataggtgacagtactgagcaccaaatggagctctgtgctcaaggggctattaatgaatgtgctcctttgttgaggtatgcatgccttttggctacagtctgtgtttgggcattcccaggctttagcttccggaaggtaccctttagtcaacctgctattggtactgggtgcgtactagcactaggacccactttgtaatgtcctccacttattgtaaagcatacatagcccagagttgtggcactccagctagctgaagcccccttccacagctgggaccagaatcctaaaggcacacatttatgcccttgccttcaccacaggccccacccaaacccctcagggtaactggctacgttcagttcacaaggctgcccctgcactacaagtcctaggcttgtatttgtttcactgcaactttagcttgttcaaaggcctcatcctcctttgtggaccagtcccagtgggcccccatcttgactagcagtatagggacctaaggagttgggccaaatgaggaataaaaggataccaacactgtaggaggcctaaggaagtttgcaagtgctttggtgtggtaggacatgggtaggcctacaccttatccataagagcagactgaaagaccttcgtcttacccaaccagatgacaaccagactgacaaacctggcctctggtctttgtatgcgttgactgccaatcctttgttcgccaagtgagagggtaaggtgggggctgtgcagattataagccagaaaaagacctaaaagttaatggaaaacatgtatcccctccagggtggtatccctgggcaagacagtccattgtttttcttcccatgtgaatgcaaattggtcttgactctctgagggcgatgggggatgccgaaggcattggctatcaatagccaaatggtatatgcccatggcttctcctacccttgtcccaagagaggtgatattgagaacagccacatacactggggggaccaccttacttaattcctagtaatctactgttattctttgtgtcccatcaggcttctgcatgggccattcagggctgttgtatgggctgtgcactggccttatagtgcctgcccaggctaactcccatatagtctctgtgatttcatcatgtccccacccttgcaggtggtattgctcagcacctctactcacggcagggctggaaagtgtcctggtgtccattttgcattctctgatcacagggttcaccacctaactctccgtcagaattcccctgcagttgtttgtggggtcaggcctgataagttatctactcccaagatgtattctgggatgggagcaaactataattagtctacaaaatgttgaccatttaaataaaaaattttctaatgtattagttgtaaaagtgcctcctatcacttcatatttttaattaatacacttagttttaatgtcttttatctgttctccatgtactctcaaaagtatctttttcaatgcgttccactggtttattttctctctgcctcactctttatctgttcattatttgtttatttatttatttatttattttgaggcggaatctcgttctgttgcctaggctggagtacagtggcacgatctcagctcactgcaccctctgcctcccgggtttaagtgattctcatgcctcagcctcccgagtagctgggactacaggggtgcaccaccatgctcagctaatttttgtatttttagtagagacggagtttctccatgttggccaagatggtcttgaactcctaacctcgtgatccatctgcctcagcctctcaaagtgctgggattacaggcatgagcctccgtgcccagcctgttcattatttattatatgaagtgtatagggtagtgattaagaccagcaaaagttctggagctattgactgcctgagtttgaatccatctgtgccacttactagctctgtttcccacgtgtacaatagaaatagtaataatatttaattcatagggttgttgtgagaattaaatgagttaatatatgtcaggtatttagaacagtaaataccttacagtaaggttctcaattatcttagcctgacagtaagttcccagttgttagccattttcatttttatataggctaattgagccaggcttctttcagttttcctcttctttcatttttcagactggcaccttagtacccagagttcagcagggaggccaggaaccttgttaggaagtagggagaggggagaagtctacaaatactcataatgtaatatccattcttttatctttgtcacatctaattataaaaacaaagacaaaagaataacttctgacttttacatgtaaacagatttagccctatattgcttccccctttcctcctgcttatccaactctcacatatatcctaagattttaatagtttttcttcaactgtgtaataatttttaagtgtgtttatttgattttagtgtttaccacatttcctttaatactgtaacccaaattatatctgaagtagtggcccatgagctgtaagggaaatgtttaaatagacagattttgagatttcaaacaaaatctccagacctgaattctttgatatcctcattcccaggagattgtgataaatgccaggtttgagaaccactgttttaaccaattgagaaatgaaacaaagtgaaaactcaagactggtgagggtagttggggagagtggtgatgtggttgaccattctttctctattagcttggaagatctatattctagctctcattctacatctctgactactttttcttcattttgtttgttccagtttttaaaaaacagatcccactttctcttaaataggttccccgccccccaacccggagtctattttggtcctctcttcctttgtttgctctcttagatcttaatattaactctcacttttctgcaagcctgttccccaagcctgttatacctcaagctctcaggaaaccgaggtcacattttcaacttgtctaaattctgtatctctgaaaacaaacccttcccctctcatctttctctttcattcattatgtattctctactcatcacctgggctccaccctcttctctttctactgcctctatcaaaattcatgctcatttctgttggaatgcactatagtgtcccctccaccttctgcctctttagtgcatcccggtatcagattaaccttcctaaaatattattccattatagtgtaatgattacacaatataaaaaaaaacttttaggttcgggggtacatgtgaggatatgttacataggtaaattcatgtcatgggagtttgttgtacagattatttcatcacccaggaattaagcccaatacccaatagtcatcttgctcctctccctcctcccaccctgcaccttcaggtacacccatgtctgtcatttctgtctttgcgttggtaagttctcttcatttagctcccaattgtgagaacaagccgtattctgtaacacaggttttctgttcctgcgttgtttgctaaggataatagcctgcagctccatccatattcccacaagacatgatctcattcttttttatggctgcatctgtcacacaattcttaagctcaaaatctttcaatgattgttcagtttatatagagttcagattattcagcttgatagccgagaacttccaaaaatatctcatgtactattattatatctcttattcctaatatttctctttactgccctaaactctatcaactggaaatgctccctaattaagggccctcatttcccctctctgtgttctcatccatttctctgcctagaatatgttttctgctttacttgtcctataaccttagcttttccttcaaagctcatttcaaatgccacttgctctaggaagttgtccctgagtaccataggtgcaaatggtgtcttcctttgaattctcatagattttatctgtcaagtgagtaaagacacttcacatttttttcatttattttcctgccgttattttaattttaaaatgtactgactacattaattcacacaattcaaacaagtaaaactatgcagagtgaagagtgggagttcttcagtgctttgccaaagccattcccatacctacaggaacacagcattactgtttagtatactatatccttctaagtcagtagttctcaaaatgttcctggtaaactccttgcttcaaaccacctggggagctagttaaaaatggaggtgcctgtgcatcaacccagcccttccgaattggaatctcttggaagtaggaactaggaagctgcactttggtcattcttaatcatactaaattttgagaatcatcccttttatctatgcattaaataagagttcttttacaaatgtataattttgtttttttgtttggttgttatgttccttcagtaatgctattggctttcttttcatttttagcaatgcatctcagagatattcataaaacaaatgtagagacgcactgtgtgtgtgtgctttttaaaaaatttttaaactctatagaatacatttaccaagattgatatagctatttttctgttgatggacatttaggctttccagtttttaattattaagaacagtgcttcagtgaatgtgtaaaatttgcacacatggtgataagtttatggagtagaagttgctgggttaagtgcatattcaaaatgcttatgctgctaaattgttctccaaacaggctttttgggttcataccaaatttccaccaattgtgaaagagaatattcatatccccacaactgtaatcagtagtacatcttatttttcagtttttcaggctggtggatgaaaaatagtatttccttgttgttttaatttgctcattttttcatgactggtgaggttgagctcctgattttcttttttgccatttgtatttccttttacatgaactgtcagttctcatttttgttcatggttattatttattgaattgtctaccatcagtgctattgaactgtccattatttgtctactgatttgaaatgtcatgtttgtcatactaacttcctataagtacattgaacagtttctgaactttttattctcttcttttaatgtatttgcatttatctcctatcatttatattatggtagctttgtagtttgcttttccttctttcttttttttttttttttttttttttttgagacagtgtatcactctgttgccctggctagagtacagtggtgcgatcttggctcactgcagcctccgcctcccgggttcaagcgattcccctgcttcagcctcctgagcagctgggactacaggcatgcgccaccatgccgagctaatttttgtatttatagtagagatggggtttcaccatattggccaggctggtctcgaactcctgacctcgtgatccgcccacctcagcctcccaaagtgctgggattacaggcgtgagccactgcacccggctttttctttcttttttaattttagagacagagtctcactctgttccccacgctggagtgcagcagcatgattatggctcacggcatccctgatctcacaggctccagaccacaggttcatgccatcatgcccagctaattatttatttttggtagatatggcatctttctatgtcgcccaggctggtctcaaactgggactcgaggggccctcccaccttggccttccaatgtgctgggattacaggtatgaaccactgtacctggcccatagtctgcttttatatcatcacctttattctttttcaaaaaatttcttggttatccctgtccattttttctttcatatgaaattttaattagcttataaaatccatacaaaattgtatttgaattttgattgagactgcaatgagttctaggttaatttggggaagatttgacaattttccaaatcttgatatctccccaaagcacagacatatttttgatgtttagtcttctcatcaggaagctggcagtctctgcagtcttctgttctttagtaaagttttagtattttctttaaataggtctcaaaactttttaaatattttgcttattgataagtatttttataattgttttgtttttgcaaacttgaataggattttttccattatatttgctaattggtttttgctgatttttaggaaaactgttgaagtttcttgcagttctagtagtttttcagccatttcatttacacttttcagtcaatgatgccatctatagataatgagtcttgtctcttcctttccagttattgtaccccatttatttatcttatcttactgaattagctaagtctgttggctcaacattgaacagtcatggtgagattgggcaccatgattcttctgtctttaatgaaaggctactagtgtttgttaatcaaatatgaggttttctataggtttgtggtagatgtcttttgtgatgttaaggaagatttcttctattaatctgagttaaagcttattatatggaagtgttaaataaatgctttttccagaatccagatgatcatttgagttttctctttaacttatatgttaatttggtggatatagcgacttacattattacttacctgaattcactcttggaaggaaaagaatcctcttgggtagtaatgaattgtgtcatattacttttatgtgatttcttagtattttatttagttgtatgacattaagttgtaagtgaaattagcctgtgaataggcagactaatggcctcacaaagatgtcctaattcgtgaaacctgtgaataagctactttacatagcaaaagggatgttgcacatatgagttaggttaacaaatttgtgctaaagagattattctagattatctacattggcccaatcaaattgcacaagtccttaaaaagggaaaacctttccagctgcaactagagaaagagatgtagcaacagaggagagttcacagagatgtgatgtgagaaggacttgtgctgactttactggatttgaagacagaggaagtgtactatgagccaagaaatggaggcagcctctattagaaaagacaaggaagtagattctcccctagagcatctagaaaagaatgcagctttgttgatgccttgattttagctcatggagacccactttggacttctgacctacagaactgtaagataatagatttgtgttgtgttaagccgggaaagtttgttagagtggcaatagaaaattaacatagcctatggtttcatctgtgtgctctccaagtttagaaacaaaactgtagctgaaaagttttctttttcaatgctttaaaacagacttcaaaaaaatcatttaagtttgataaaattaagctgttaaacctggctcttgtgcctttttaaaggagaaaatatttgattcttcaatttcttttgtgacatcttttcctaaacatgtgttataattctcaagtatatattttgtcttccccactagactggaagcttcttgaaggcataatgtgtctgattaatcttgctatctaacttagtacctaaaataatcccttacagtaatgcaaacatttatatagatatcttattcaactttgcatcctcatagcactatatacagtgtctaatgtttatgaaactaatttcaaaaatgtatggtaatttagacagcttaattgattaggtaattcagataatatgctgagtgaacatgagctttgaagtcaggcctgagttaaatcctggatgaaccactttcctaactctgtaaatttagacagttgattaacatctcaaagattcactttcctcactagtaaaatggtaagtaaaatcctcacttattttatagtgaggaaatgtttgtagagtgcttagcacaatactggataggcaatcgtcgctttatgttagtaagttatgaagataaaaaatgttatttagaatcaaatggtattttataaaaatgttactttttctgttgctcctgttgtaattttttaggctgttgtcatgtcaaaaggggatactaagtttccaatctgttcttgagtatacagtaatgcggtcaataactttagttggtgcctccaacaagtattatccgtggatgaggttacatctgggtactttggaatatgatagaagcaacatctggtgtgcttttatacagctcatgaagtcagtgctttagaaactgaattaaaatgtttcaagggttttcttcctatttaatgctgtgatgttgctaatcccgtcctcctcttaaagctggtgatcctcctcacattaacggccattgatatagtttggataattgtcctcactcaaatctcatgttgaaatgtaatcctcagtgttagaggtggggccttgtgggaggtgtttgggttatgggagtggattcctcatggcttggtgccttcctctgggtagcgagttcattttcacgagatctggttgttcaaagtgcatggcacctcccctactctcccttgctcctgccttcagcatgtgaagtgcctgctcctgctttgccttctgccacaagtaaaagcttcctgaggcctctccagaagcagatgccagcactatgcttcctgtacagcctgcagaagcatgagccaattaaacctcttttcttataaattacccagtcttgagtatagcaatgcaagagtggcctaacacagccatccttgatatttatggaaccctctcaggcttaatagttgactcaagcacaatgaataagtggtcccctgtctttgtgaattcatagataaaaagacaagacaatcttgtgttgtgacttgttttgtagtttccattgaaatcttgtagggtaggttgtagtgaagtgtgtatcttacatcattttctgggaattcatagggaagaaaaattgaagataagaaaatttaacactgattttcttgctcaatatggttctaaggagttgatatcagattttgaattgggtggtgatggtggagatgaaacagtgaatgtgtgcagaccaggcaagactgaatgaagagaaggaatggggctataaaagacactttgccaaaataaataatagtcactatatgtcatatccctactatgtgacaagattgttatctgctttatagacatcattttcaaacctatcgataaccttgcaaagtgaattttttggataaacaggccctgaggagaactttgccccagtaagttttcatagggttggtgatgcaaatctttctggatacaaaagccagtggaaagtagtacaaatcacgtatcccttatacgaataaagaaactgctggagtaccacttctctcctggggttgaagagatcatttaggtaaatactccttttaaagatgtaaaagctaatgatggtttacaaacttaaattcttacactagcaaggagtgggagctggccattggagagagagtactgacggacgtggtaagaaagtaggatttcaggtttagatataattcattttaatgaatgtgtgggaatacacagaagagaaattatatggctccaggttacttagtattgatctaagcttcagtttatacaaaccaatttagactttcctgaagtataaattgagttatatcttaattatgagaacatattaataaactaattaatataaacaggactagactaccccaaaagattcataaactaagcagcagcagtggccctgtatcatcacagttgcattttggaaggtaaaattaaccatttggaaatatgtattccatcaccttctttatgcaaggtacttatttaggctgaagacacaggacagaaaagggctttgcccatatatacagatgaacatggacaaagataaacttcagataattagagctatgcagagactttatggtattgtgaagagacaattttcgattatgtgtaataggaaggtgtcccagaggatgtggcatttaagcagagatttgaataacaaaaacaaactagccatggaaataaaatgtaggaggaagaaattctaggcagagggagtagctagtgcaaaggtggtcacatgatgtgtgtgggtgtgtgtgtttccccctaggactctaacacagaaggtgaaggagagaatggtgggaagttgcattggagaggtacggaggggctgcatcatttacatttggcccctttatgataaggggtatccatattaaagtaaattgcctctagatgggttaagaacagtgtgtcataaaagtcaagtgaacaggtttcatttatatgtaccaccagatgctgcagtgcaagaatgttttctgtaatgtttgtttttattttttgccttgtattaatgctagtgtatttaagtttccactgtcagcccctgaagagcagagcagacatctgctccttctagtacctaatccagtgccatagcacagaaattctcaactagtgaatcaatattgattggtgtagactagttaactatgttattgccacaaatgacatctaacctgagctagttatcccacaaatagtcctcacagttatgaaaagggaaccacagtgtgtgatgttccccttcctgtgtccatgtgtccatgtgttctcattgttcaattcccacctatgagtgagaatatgtggtgtttggttttttgtcctttcaatagtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgtcttccacaatggttgaactagtttacagtcccaccaacggtgtaaaattgttcctatttctccacatcctctccagcacctgttgtttcctgactttttaatgatcaccattctaactggtatgagatggtatctcattgtggttttgatttgcatttctctgatggccagtgatgatgagcattttctcatgtgtcttttggctgcataaatgtcttcttttgagaagtgtctgttcatatccttcgcccactttttgatggggttgtttttttcttgtaaatttgtttgagttctttgtagattctggatattatccctttgtcagatgagtatattgcaaaaattttctcccattctgtaggtagtctgttcactctgatggtagtttcttttgctgtgcagaagctctttagtttaattagatcccatttgtcaattttggcttttgttgccattgcttttggtattttagacatgaagtccttgcctatgtcctaaatggtattgcctaggttttcttctagagtttttatggttttaggtctaacatttaaatctttaatccatcttgaattaatttttgtataaggtgtaaggaagggatccagtttcagctttccacatatggctagccagttttcccagcaccatttattaaatagggaatcctttccccatttcttgtctttgtcaggtttgtcaaagatcagatagttgtagatatgtggcattatttctgagggctctgttctgttccattagtctatatctctgtttttgtaccagtaccatgctgttttggttactgtagccttgtagtatagtttgaagtcaggtagcatgatgcctccagccttgttcttttggcttaggattgacttggcaatgtgggctcttttttggttccatatgaactttaaagtagctttttccaattctgtgaagaaagtcattggtagcttgacggggatggcatcaaatctataaattaccttgggcagtatggccattttcacaatattgattcttcctacccatgagcatggaatgttcttccatttgtttgtatcttttatttcattgagcagtggtttgtagctctccttgaagaggtccttcacatcccttgtaagttggattcctaggtattttattctctttgaagcaattgtgaatgggagttcactcatgatttggctgtttgtctgttattggtgtataagaatgcttgtgattttgcacattgattttgtatcctgagactttgctgaagttgtttatcagcttaaggagattttgggctgagacaatggggttttctagatatacaatcatgtcatctgcaaacagggacaatttgacttcctcttttcctaagtgaataccctttctttctcctgcctgattgccccggtcagaacttccaacactatgttgaataggagtggtgagagagggtatccgtgtcttgtgccagttttcaaagggaatgcttccagtttttgcccattcagtatgatattggctgtgggtttgtcataaatagctcttattattttgagatacatcccatcagaagggatagcattagtagatatacctaatgttaaatgacgagttaatgcatgcagcacaccaacatggcacatgtatatatatgtaacaaacctgcacgttgtgcacatgtaccctaaaacttaaggtataataataataataataaaaagaaaataataaataaaaagggaaccacaaggcctactagatcagtgaaaattcatttactcaagacaactccaagtacataatgtcttaggtaatactctatataaagtggtttgtcacaagagctgtgcttgctttcttttgaattttatgcttcacattctgtgggaaaatgtattacacagtatctcacagaagtattactattaacctatatttacttataatactatcttctatagcgtgatgttaaaatttgataaattttagggaggaaaatgtttgtctttctttttttctcagacaagctcttagtctgttgcccaggctggagtccgttggtctaatcttggctcactgcaacctccgcctcccaggctcagatgatctttgtgcctcagcctcccgagtagcgaggactacaagtgcatgccactgcgcctggctgatttttaaaatttttgtgtacagatgatgtctcactatattgccaggctggtcttgagctcctgggctcaagcgatccgcctaccttggcatctcaaagtgctgggattacaggtgtgagctaccacacccagcctgttcattttattataaataatttgttggaactttctcagttatagaattgatgttagcagttcatttaaccgtaagactaaagggatggtttgtgacatcctgactcccattctgtatctcttcattccaactggcaccattccctaggcccacagggtcttccccactgccctcccctccccccacctgccctcaccttttctggtcacaagctccagaccattccactttcctatcaaaatatgtcttcttacttccaaattcccaagtccctgttctacttccaacacactgtactccagtactttaatccgtggtaatgattcagtggagccagagaatataaagctcattatacagttagttaagctgttaggccctctttctgtcttaagcatctttcttcttgcagacagtctcaaagatttttccttcttccagtaatcacccatttatttccaaggaatgtttcatccatgcctagctttaggaaacatgttattgcttggatttctattgaaaatatgtgtggcaatttggaaaccattttttcctgacttcattattctttcatgttttagcctgtcaatgcaaactctattatccagagatgcattatagaacaggagtttaagggagaaggaaattaatattggccatggtcatgttcgtattctttttccttgtagaagacaacaggcatagctagagtggcattagctaactgtaaaaaggatttgtagggctagggatgaatgtaaatgtaaacaacttaaatgtggattctattatagcttcacatagagtatctgtgaccacaaatcatattcttctcagtagctgatttcccacaccagttcaaagggctacagaagaaatactgtcatcaggacactacgaatagtttacttggatatatgcaataaaaggatgcaagtatattttctcgcattttcttcctaaagagttgcaaacagggctggatctagaaaatactgtttcctttttttggggtaatgctccctgccatttttatggtttacatgggcattccaatccatcaatagatttgttttacagctttcaaattattaatgacaaattcaagaaacaattctgcagtcaatgcctatggtctaattttttgtagttttcctttaacttaaaaaccatagaaagaagtaccatctttgatactactgatgggcccaaacttaaaaatttatgatgcaaaatagttttagctatcatttatgattactaaaaacaaccattgacaataaatattttatactatcacaaaaagcagactagctttctcataacttagcaaaggtgttatggttgaaaataaaattcaaaataagttgaactgcttaactcataattactaaaagttcatactctatagtgccatatgtaacaagattctcatttaaaaaaatagatgcatactaatttagaaactactgagatggttattttccttttttgagacctagctgtcacccaggctggagtgcagtggtgtgatctcagctcactgcaacctccgccttccaggttcgtgcgattcttgtgcctcagcttcctgagtagctgggattacagtcacatgctgccatgcctggctacgttttgtatttttagtagacatggagtttcatcatgttggctaagctgatctcgaactcttgacctcaagcaatccacccacctcggcctcccaaactgttgggattacaggcatgagccacccagaaaactactgagattctgaaacaaatttagaaaaaagcatacaaaccaaagtttaaggtacatttaaaaggctttccaattgttgagatttccatttctctgccaagagaaaaacagggtttagaaaaaccagcgtatctccttttacgcatttagagatctttaaattgttagctattgtagcctgcttgttcactgggttttgtagtgtgtatatatataggccaccactaatatacttcgggagctttgcattcacagtagctcatggatatgactttaacatgaattatcatactatcatggttatggcaattcagttttttttaagaataaagttattataatacaaacattccttgtagtaaatgtttgtattatgggttttttttttttttttgtaacaaagaatttgttttctacctttgttatcatttaacaagcaatttacaaaaccaagaaggaaccaaatctttgatttacatttctgctgacctagtgtgtggactcttgcagaggaatagcattgctgcatagtgctcagaaagtgtgggaaaacggaacaaaaagcttgaatccatttttttttctgcttttacatcagaatttatatttaggttatactttcctagaggaatgaacaatacatctctcttatccacaatgtgtaatttgctagttttgtgtttaaagcttttcttatttcctgttctacttctgtgaattaaggattttaagcaggggcaaaactgtagcatcagcaggtaatcattcttggatacagatactaagtacatgtagcatgcttgtcttcactcttaggtcataagctccatgagagcaggggacaatgatcactccaatccttgctgctttcccagcatatagcacatggcagaattcaaacatttgtttaataaacaacaacaacaaaaaacctttcatatcatgaggaagacatctgctgtcctgaaagagctgataaattatgtagcttacttaaaaaaaaaaaaagaatatgatatggttgacatacaataaagtagaatttatgctgttgccctgcttctgccataaacatgacaaaacatgacaatgggaagtcacctgagttctctggatctcagtgaataaatttatgacattaagggatttaacaaaaatgaaacccagtgggaaaattgtacaagtcactcaagttctaaattgcttcccaatgctgaaatcacttagtgagatacatcaaagaccacagaactttcggtttacaagtaacagacaaagaatactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgta

SEQ ID NO: 1240 - DNA, 11004 bp, Homo sapiens
agccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaa

SEQ ID NO: 1241 - DNA, 357578 bp, Homo sapiens
agtccattttcttgacaaagatttgacgattgaaactatttattagtagccacctacagagctccaataaataatagcaaacccaaggtaaacaggattctttaccctaccacttttctaagataccaccaaaatgaaagaaaggaaggaaggaaggaaggaaggaaggaaggaaggaaagaaggaaggaaggaaggaaggaaggaaggaaggaaggaaggaaggaaggaaagaaagaaagaaggaaagaaagaaggaaagaaagaaagaaagaatttagtaacagaagatgctacctgatttaaaccctcaaaaaatctgtgattcaacttaaaaaaattaacagaagaaaatagctctctaaagcaaagcttttagagtttattttagaagaaggtggtagtgctacattattttttaagtaatatttacagaacagtttgttctggagttctaaatgacacaaatagagcaggcctggtgtacacacaccaaaatggtgacaacgaaattagggcttgatccggtgataaattaccctctgctcatctcacgaacacctaaggctccaaaatggagaaggcatcatttgaataagtgaaccattggctacaaataagggcacacacccacttacccccaccaaccctccacatacaattacccaatctctaagagaaagacacgctggctctataattaccagatgtgaactaagaaactatgcccttttaaaagcttagctatatttcccaatcacactttactcagcctcagagcaaactccaaagcagtatgatgcctgctcctgaaaagtctaaagggaacaatagacagcagggcctacttgagggttgagggtgggaggaggatgaggatcgaaaaactacctatcaggggccaggcgcgtggctcacgcctgtaatcccagcattttgggaggccgagacaggcagatcacaaggtcagcagttcgagaccaacctggccaacatggtgaaaccccatctctactaaaaatacaaaaacacaaaaattagccaggcttggtggcaggcacctgtaatcccagctactcaggaagctgaggcaggagaatcgcttgaacccaggaggtggaggttgcagtgagcagagaccacgccattgcactccagcctgggcgagacagcaagactccgtctcaaaaaaaaaaaaagaaaaaaagaaaaactacctatcaggtactatgcttattacctggatgatgaaataatatgtacacccctgtgacatgcaatatgcctatagaacaaacaggcacatatacccctgaaactaaaataaaacttaaaaagaagaaatgtctagcccagaacaacgtccaaatctacctgctgggggacaaagcaatatcactgatgctagaatttgggggacaggaggtggatataatttcatattccttatcccaacatgtcactgtgtgttattagtgcagaaggaaaaaaataaaatttttcacagccaactgttttgtttagcttcaacaggggcttattgtcaactacaatagaagctggcctatctaaaatctgcaacctcactttccaagagccaaaaaggaatttgtaaatggcctctgcagagttcacacggttggcatatgagccttattcatatagtaggccatgcctaaagactccatggagacctattgtatcttcagtctgttgactcttacttgacacaaaattctaaccaacctggttgattttaaagtttacagctcaaactcaggaaattccagtatgaagacaaatcaaaggcacttggaaaagaagaggatatatatatatatatacagtgaaatgctcatggtagagacaccaaatgctgaagagagagatgcattaaagaaatgaagaagagtccatgagcccattgctcaaagaaggccttcaagggacagtgcaacttgtcaaaagccagaacagactggagccaagtaaaaaaggagagcatggaaacaggcagtacactaggatcaatagaaaaggaaccaactggaacaatccagagtggcaaaaaggccatgattctcatgctgttggagtggcagctgatgtttatcatggacttacacattcagtcttggtgcaaagtgctttatctgctttctcttattcaatactctcagcaaccctatgaagcaggctttatgtaaattttacaggtgagactacaaaagcttagagagttcaagcccaaggtcaccttgctaggaagagggatagccagaattgaacttcaggtccgcctagttccaaagcctgccctggggtggaggagagggagaggcagacagaggaaagaaaaaggatgatactattaatggtatttaataatattttgttacagcagcctaggtaaactaacaaccccatttaacagatgaagaaacagagcaattctttaaaacattcattctaaaaaagaagaaaaaaaactttcccagtggaagataaaactaggggtatttgacaggcaaaatgactccccttgtaacagaacactgcgaaggaaaattaagcagaactactagatgacataaaataactgaccatttgtacgcatcctttttctttcttttcatatttgaaataacataacttgcagtaagatcagcaaagggaaaatctctgtaacaaaatttcatttatagaccatacccatgaaaagtttaagcttgacactgatacagggcagggcatcatcacctgaaagaaagggaaagagagacagaaagaaaaaaagaaaaagaaagaaagaaaactaacaacccagaaaactaagcagctcattacatgttctcttccaaattctgtagaaccacacttgaagtgacagatgtgaagaggaaggaggttcacactcagaaaggcaggagaactattttggggaggtttgttggaggaggtggcagagtgcctagagaactagtgcacagatgtagctctggcatgtgtatccatccattcattcattcatgcatacatgcatgcatgcagccaacatttactgagaccctactatgactcatcaacagaagatggagatactgtagggaaccagacatagtctctgcccttaagaaactcacaatctgctgggcaattacagacacgtaataagtcaatgaatagtcctcataatggggactttaggaactaagcatgagatacagggagtagaggaaggcttcttggatgtgacatgtgagtcttgaagtggagaataaccaaggaaagaagtggaaggaaggctggagagattaccagggacagggttttgcatgccacaatgagatctttacattttatcctgaaaggaatggaaagccattcaagattcattatccggataattacatgtccagattaacattaaaaaataaaaatctagagacaatgtagataacagcgtggaaagatatttagactggaggcaggtcaagagactactgtattatctaggctagaaatattaaaacctaaactaaggtggggatgggggaaagtgaaaaagaggaaaccaagttaagagacacttaggagacagcatcagtaggcatttggcactgatttgtacaggggttacaaagaagacaaaagaagaatggcctcaaagtgtgtgatttgattgtggtacagctaggatgctggagacattccctaagaacagaggacacaggacaagattgcggggaggtggcaagctcagacttgaacatgttgaatttaaagtgtctttgtctggaggtcctagtcattggtgtctctgtgttgcacccactgtattagttatatattgctacataaggatattaccacaaatctagcagttaaaacaacacacaaatatttatttcagtttctgtggatcaggagtctaaatatgacttagccagttcctctgcaagggtgtaatcaaggtgtcaggcagggttgggttttcgtctgaagttcaactggggaaggctccatttcctaggtcacatggttgttggcaccattcagtactttgcagactgccagactgagggccctagtttcttgcttgcttttgattggagattaccctaccctctttgccacatagccctctccataggcagctaacaatgtggcagctttcttcttcaaatctggcaaaaaaaagaaactccttccaagccagacattacaatcttacgtaacatgatcatgtgcatactatcacatttgccatattctactggttagaagcaagtcacagagcctgcctcagggcagaggatcacaaaaaggcatgagtctaggaggcaagggtcatggggtctgttagagtctgttagaagggtccttagagcctgtttcaccacatccattttcatttagtctccaaaagttagaaacccttagacctgctttcttacctcctatggtcccatggcctaagcaactagatactgaattgtatgcaaatatagatctacaacccatccatccctctcagttcaatctctttcatgaagctgtcccaaggaggctctcctctctctctctccattctgatctcatagcacttaaaatctaaagtaatggcttcgagaatttgagtgtcagaaaactaaatatcccccaaaaggaaccaacccaaatgtccatcagtgatacactggattaagaaaatgtggcacatatacaccatggaatactatgcagccataaaaaatgatgagttcatgtcctttatagggacatggatgaagctggaaaccatcattctaagcaaactatcgcaaggacaaaaaaccaaacaccacatgttctcactcataggtgggaattgaacaatgagaacacttggacacagggaggggaacatcacacaccagggcctgttgtggggtggggggaggggggagggatagcattaggaggtatacctaatgtaaatgatgagttaatgggtgcagcacgccaacatggcacatgtatacatatgtaacaaaccctcacgttgtgcacatgtaccctagaacttaacgtataataaaatatatatatatatataaagaaataataatagctgtcatgtattaaatgcttactatattttactcactatactggaaaccaaatatgcaatatctcatttaatccttataatgataataaattaagggtacatattattccaattttaccaatgggaaaactgaggcatagagaggctaagacactcacccaaagtcagatagctaataagtggcaggaatcaggcagcctgactccagagcccacactcaaagctagcccaggcacttagatatcaccagttacatttttacgatcttctgaatgagaaaatacaaaatagctaaaagctactttgaatccagtaacagttttaaatacaattttccaacacactagtatctacaaacatttgcaaaaagctgtatgtacatgtgcaagcatttattctctccacagacaatggggattggcgaccattcgcagagcctcacagcccttcctacatggctcttcgctgggcaccagttgccactgccacattcttttggtacctggattgtaatgtacatcagcaattctcaaacaggggcaattttgctcccaggagacatctggcactgtctggatacattttttattgtcatggttagggagggggtgctaatggcatctagtaggtagaggccagggatgccgctagacctcttacaatgcacagggcagtcccccataacaagggattatccagcccaaagtatcaatggtactgatcttgagaaatcctaatatgtatcactgtaaaatgctctacttctctcatacatatttgtcctaactctccaagataaacctctatgccatcagagcaggaactacatgatacccatgtcactccacctttcccagcctatgcctaagttcccaaacacgggaagtgtccaagagatactttttgaattgaaatttatttcaaagaaattctaggctttacttctacaagacctagttattcaatgattaacacattccctccaaattaagaacttctagtttgaatttactgaaggctaatttacttctggagttaacacagccctccccagcagcctccggcacctgtatgtttgaattagcaaataaatctctggtttagaaaaatcagataaatgaaacaatatgcagaattgagacaaatagggagatacagaaacatcatcaaatgccaaggactggaaggtgcctatttcctaatgcaaccactctccccttaaacaaaggcaagggcatgcaaatgaactagggtccaaaaatgatccttttcttttttaatcacaaatcattgtgagtgaagagaacattgttctgaagcacatcagatatatttgctgaatgatgaatgagcccctgttgtttgttagcacaagtgggagttatgtgtatattaagatgagaacacactataattctaagaaggaaaaggagctattatttcacctttttttttcttgttttctttttctttttcttttttctttcttttttttttttaacacattctcactctgtcacccaggctggagtgcagtgacgtgatcacagctcactgcaacctcgacctcccaggcccaagtgatcttcccacctcagcctcctgagtagctgagaccacaggcatgcacatcatgctcggataattttttttgtaaagacaggatcttcccatgttgcccacactggtcttgaatttctgcactcaagcgatcctcctgtctcagcctcccacagtgctgggattacagcgtgcgccacgacacccagcctatttcacttttcaacatacagaaatttaaactcatattccagacgatgagtcagatgactcctccatccaatgaattttgtacaatgtaggcaaatattgcattgtgtatttccacacctctatgactcaatcttagggtaaagtctggttcctctttccctctcagataaacaaaaaacaagtccattgaatcccagaataacttgaaacctttgggacctgcctacactgctgagaaggctctgaaattgttctgtctgctccagcaccgtactttccatggagaggtgatgaatcagactggacaggaccacagggtctctgaaattcctcaggagaatcttgattacacccaattagtgagaccatatacagaagcccggtgaatcagacggcctcacaacccagcaggtcagcagggctagaaaaccaaggccattagctcctgctgtgtcctacctctcaaagaatcaaatccaagctggttgtgaaaaacaatggccattttatacaatcagtcccagattatttttaagggggatgtgagagattcaaagcagtggagaacaccaaagtcactaatagtcacatttagaatccaccagaggttgttttttgaaatgaaaaatctgacttctcaaatacaattttcctaggctgatttaaacatttctcccaagctctctgggccaaatagcatcagaaaacagtaatacaggtatgtacgagggcctggggtaaagtggcctgggctgaagttcatctgagcattggcctggttctataaggttggtaagctcatgtaggtggacggagcccctggctaaggcctggttcaaagtttgagttggcatgtagttggcatctgactataccctgtcgttcattcattcacatccgactcctgagctcagacctcaatacctcccaggagttagccctctcttgattcattccacctacactggtcaagcatctactctcacatgtaaggcctttattctggcctttccttcctttcctggtgcctacatacccagattttacgcattctccacaattctgtggtccaaatccaagtgaacctcctctaagaagctaaccctgaccaactccagctaacacagtctcacaatattctctggataccagacatcagagcagctgtttgttgagctcagatgatactccaggtaccatgcccaacatttcacataactgatctggtttaattttcctatgctgggtaaatatcactacccccactttattgatgagcaaactgagactctaaggaaaagcatcttgcccagatttcacagctaataaataatggagctggaacacaaacccacaactgtctgacagtagagtttaggcatgaaatcaggggtcagccaactcttctgtaaacaagcagatagtaaatattttttgcaggcctcacattctctactgcaacctctcaactctgcctgtcattgtagtgcaaaagcagccatgcttctatatttcaaaatgaaaaatctatgtttctgtatgaaacatcctcctgcatagagtcaaagggctctaagccccttagcagttctcctctcaccccagtgcacacagctctggacttacccacagtaacagcaacctttactgggggcctgttagaagccagactcttcccaaagacctcacaacaatccttacacaaggcagaggccattaatttctattctcacgtgagccaatgagctttgagaagtgaaggaacttcacaagcttgccccagcagtgaggtgtggcctggaacttgatcccaggcagtctgacttaacaaccacaacttccacctctacagcctgcataggcccaggctgactacagctggagctggcacctcttcagcttgagctcccagcacagggtcctggtctcctggatgctctgctgcccatgtgtgtccacaggagaaagttacagggttgctgcagcctctggcttctgacgtgggtctcacagactggcagtcagacctacagagtgtaccgctaatggctttaaacaagcagaaatcatattcagctaactaaagatcaagggccattgcaaaacgcctgatttcatattccattgttaaactttaatgagccattacatccactggaatgaatgatctagtatgtcatatcccataacataatttttaaaagtctaaataaatactgcaagcctcaaggaaatcacttcacagagcctcttccatttatggcccccactccaggtgtgcctgaatctattctgaggcaccaacctgccacatcaaacgacatcatccttataatgtttccttttccaccagactccttctgccctaattgtgcaaataatggataaagacaagccccataccggctaagcagagaaagggggaatgggtcctgataacaaagtaatcaatccttgctctccctgtgggttgatatgttttccagtggcgcatacatgagtttcagagtcagaaaatgagtttattgttggaatgaacttgaaccttagtaatcctcaggttcctcatctagaacatgagaacagaaatgactatggcataggtttctgattacaccgaacaatatttctaaagtgactgacccaagcactagtccccatcctcctctctttcctcttatatattttatttttaaaccacatgaaatggaataattatcatagtgtctgttgttttactttccatacatattcttttaaacttccaaatagttcctagcatgaagtagaagaggcactatgacataattatgttggaaatgcctacagaggtggtcttctgagttttttttaggtctgcaattaagtgtatgaaatagttaataggtcaaaagcctacttcaatctagcttacatagtcagtgtggtacgtaatgcaactatcacctaactgaccacacatagcttggtttctaaaaggcaataacatccaaaaatgtgcaacagatacacactcaggctggtggcttaggccagggggcctaaagccagattcctcagttcaaatctcaactctgccacttagtaactgtggatgtgggcaaatctgtagtctctccaagccttggtatcctcatctgcaatatgggataatggtgcttgcctcatgagcttgttgtgaggatgaagtgagataatccatgtaagacgtttaatatactacttgactccttgtaaggattcaatacctgtaggttattattcttagtgtcactattaatgctgacttgtcatcactgaggtgatcctaaagaatatgcaattctggaagaagagctgaaagagaatgaaaagcaataaaattgcagagcaataaaatcactgggtagggtagatggcctaaggtgacacttaaggggctaactcagttgacagaaatgtattttaacatgtgtgtacgtgtgcatgaatttgcaaaagtgtacacatgtgcaaaatctggcatatctgctaaaagccccatcacaatatcatcatgcctcatgtatctaaccagagtggggagtctatcacagaacaactgtcaagttaaaactggatcatcactgtccaaatgaaggcaacttctcaatttcctttttcctttctctacttcttgtcaccctcccacaaatgaatatgattacccatgccaagaatatacagcttagaaataagatcaggaagaaaagcaaaaatgaaaaagaaaggcctaggagaacaggaaagcagagaaagtgattaaaaagcagaaccacttgactgacaatcattcatacaataaacaaactctgtcagctgctctacaacaaatattctattaactgctcaatgttgttgtctctaattcttagaaccagtgtacaaaatagacattattattcccattagacagaacaggaaaccaagacaaagtgacttgcccaaggccacatggccagtgtcttagtccatttgtgttgctataaagtaatacctgagactgggtgatttataaagaaaagaggtttattcgactcatggttctgtactctgtaaaagaagcatggtgccagcatctgcatctgatgagagcctctagaagattccacccatgggggaaggcaacggggagctgcatatgcagatcacgtggcaagaaaggaagcaagagagagaggatggaggtgccaggcttttttaaacaaccagctctcatgaaaactaacagagtgagaacttactcattactgtgaggacagcaccaagctattcatgacagatttgcctccacaatctaaacacctccccttaggccccaccttcaaataaatttcaacatgaaatttggatgggtcaaatatccaaaccatagcagccaattaatggtaagttaggacttgaatcctaccctcaatagtaacaaaaatctttttttttttttttttttttgagacggagtctcgttctgtcacccaggctggagtgcagtgaggtgatcttggctcactgcaagctccgcctcctgggtttacgccattcttgagtagctgggactacaggcacccaccaccacacctggctaactttttgcatttttagtagagatggggtttcaccgtcttgatctcctgaccttgtgatccgcctgcctcagcctcccaaagtgctgggattacaagcatgagccaccatgcccggccaacaaaagtcttcttaatagtcccttctacttctctagactctggcaggtgtggggccctgtatatagaaaccgaggttggctcttgccctcaaggagcatattgtctaatgggaaggaaagacaaaagcaagtaatgatgatacaatgtgaaaacatgctctccaaggctaaaacaatgtgttttgggagctccaaggaggaaaggtctcaacccagcagcagagaaagcttcacagaagcagcaatataagagttgtgtactgaaggatgagtaagtttaccaaccagaaggccagccacagtggctcacgcctgtaatcccaacatcttgggaggccaaggcaggcagatcatttgaggtcaggagttcaagaccagcttggccaacatggtgaaaccccatatgtactaaaaatacaaaaattagccaagcatggtggcataggcatgtaatcccagctactcaggaggctgagataggagaatcacttgaaaccaggaggcagaggttgcagtgagctgagattgcaccactacactccaacctgggtgacagagtgagactccatctcaaaaataaataaacaagtaaataaaaataaaaagagttcatcagccagaaaagagggaaatgggcatccactattggggtagtcatgcaaacagaagcacagaggtaggaaagatcctcgcatgttgaaggtggtaaggtgggagatacgtaactgaactgtgagagaactagaaccgggctgaagagaaagaccaggggctgattgtgaaaatttttgtctgacgtgctatggagagtggggaagcttctgtagacaaatttcaggcaaaaagaggtgggtgaggcagctgctgcaccaggacggattaaagaagatgaggaataaaaacaatgggatgagctgaaggcacactcatggggtggggacatcctgggagacaaggacgtccaagtctgacatgaaacatgaagaaaagatgatgtctgttcaagagttccaatgaggcaaaacagcctactagagaaagcaattaaggatcctcaatatttaggattctgaagtgaaaacagaggaatccaaaaacatacataaagtaagaaaaagcgagagaaaatttcaaaagtgaaaatgatggagattagcacaagacctccagcagagatcaacagaacccaaaatataaatggtcaagactcaatattctatgttttaaggggagctgcactaagaggggtaagaaattgaaagcaaccaaaaaataaaaacaaacacactaagtctgttttagagataaggccattggaccatggaatacacccaaggacatcagaagggccatcaggcaccatcagtaagagcagatgatggcagccaagccaacttgagtagtagagatggttcatattactgcagggacaggggttaggcccacaaggtggttttctgcattttcccctgggagatgcatcgtaaatcatacacaggcatgggtgccagggtacaacccaggaaacactgagacctgcagtaacagcacaacttccttgtaatcttcactattgctcccatgatgctggctccaagtcatgactcatacttaggaatcaaatgttctcccagaaacactgttttaattacacatgccacttaaacagaaaggaaggccataccttcccattgatggaggcagaggcttaaagctcagccaatcctctgtctgaaggattcaggaaatttcccggtaagacaaggtagagaatgaacactatatctcctgctaaatgaaaggaaggacattggttgaccaaagccagagagacggaggaagggagggaggaagggaaagaaggctgatccacagatcaagctactaggaaatcaaggaggaattttaagtgttagagcttcaaggttcctcagagatcattttatccaacttcctgttttatagataaggaaaacgggccaaaataaggaaaacacctttagattcacataacacattggtaggagagagagggaagtggtggaacaagggtacatcacaccttcccattccaagatgctgcttttgccagggtctactatccaagtcctcagataaaccagccccttctttcaccagtggattcaaacccatgttggggaaggaaagagataaggagaagtaaatgggagataaagcagccacactctagttctggaatactccgaattattgattttggtggtggatggatggcccctttcagctgcactctcagcgcctgctcctgttttatgggtgtttccagtgtgcctcaaattatcttgcctcttatgaaaatacaggaacaattacatacaagcctattcagaagggacaattagctatttacatcagcaaagaaatgacagtgggctcttcctgacagatgccatcctcacactgtgttagagcagagagggaccttgttctggaaactgtccaatagctggaaggagacacctcctctgttattgtagtgtctttcttgcatttctgagcctgagctttctagacttctcaaaatgctatccagcaattggcagacccatcaattgaggatattggctcctcatcacctggtctcctttgggaggggtacacaggatagttgcaattggtttttaggacagccacatgcagaaacaaatggtagtcagactatgcagcagtataatgagcatcatttcctcatgatacttttatgatatagaaggaaataaagaagtgaatctgtggatggtaataaagtaaagaatagagaaacaatggatcaagatggaaaggaatgcaatgagaaatagattaaatgcataatcaaagcttaggaataaactcctgatgaatcaaaatgaccataatttaaaaacaaaaatagatctgctgaatttcaatttgaacaagccattcaccacataaaaaataaacatacagtatttcaatcttagaatttaagccctattttcaaatcaattaatcaaatactcatgcctgccaactctggcactagacatggtaggacataggagggaaagataaaataaaccagtatccttatccaaagtagctcgaaatccaatttgtacaaacaaggtgtacatgactgaattagtgaaaaggagaatttatacagtgagaagcagaagcaaatagggcagtgacacagcaacaccacatgtttcttctagtgaccagagtaactacctgagtgtcaattttctttgtattgaaaaaagggtgaatacagagtgacttgtgcttcactttaaatagaaaagtatttaatctatcaatgtaactttaaaagtcaaattgggcaaaactacaaattagtcttccatgctttagtctatatacctgtgctagagtgctctttccaaaacaaaaatctcatctcatactcttgttgaaagaaggaaagagggaagaagggagggagggagaaagggagggagggagggagagagggagggaggaagggaaaaagaaagggaaagggaaagggaaagggggaggggaagggaaggaagggaaggagggtaggaagggaaggaaagcaagggaatggagaataaaaaactttaatattccctcattgcttacaaaacaaaatccaaattctttagcatggtttataaaactcagtccagctccgtggcctagcctctgcctaaccaagttcattctcataatatgctgctaaatttaaaagtagactacagagcaacatgtacattcacactaagtgaataagcctgtcagagaaggggcaaatagtatatgcttccacttgtatgaaatacctggaacaggaaattcatagactcaaaaaagtaaattgaaagttactaggggctgggggattgggaaatggagagctattgctaagtggttagagagctcccgtatgcggtgataacaaagcttgaaaaatagtgtcgagctgtcaatagctgtacaacactgtgaatgtaattaataccattagattgcacacttaaaatggttaaaaattttatgtcaaatgttatgttacacatatataaacacaattttaaaaaattaataatgtaacataccaaaaaccattgaattgttcactttaaatgggtgaactgtattaactctatttaaataagctgttacaaatgtacaatatgtacatacaatactaatgtaggagaaaggcagaggaagattctcctaactgctaacagagattacctctggatggcaagatgcaggggatcctgttttctgagctttcctacatttcccaaatttttattagaactttgctttgtgctacttttgtatccataagagaagaataattgccatttttaaaatgttaaaactttaagcaagataaaaataagatataagccttaatcttctcccgttggggctcataacacatggtggtggaatgccagaagggaccctgggcactcagtactgcctgcattcttcttcgctgggtgagcctctggccacatgaatgtctgtgcttatgatgctggtggcccaaagagcttaatgatgcaaccagggactctgcaggaagactgctggagttccaccactcaccaagtacctctcatagcctatgtttcctcatcggaacaatgggataataatgttatttacttcataaggttatcaaaaaagtaaatgagataatttacatgaagtgtttaaaacaatgtctgatacccagtattctgacctaagtgtttcatcaatgattggcggctattatttttactgctgctgttgctctattacactgatgtgagtacagtcatgtgctgcataatgacattttaatcagtgactgtatataagacaatggtctcatcagattatagactgtatttttcctatatcttatctatattttgatatgttcagacacttaaatactaatcactacgttacaattgcctacagtattcagtacagtaacctgctatacaggtttgtagcctaggagcaataggttatctcatatagcctaggtgtgtagaaggctctaccaactaggtttgtgtaagtacactcgacaacgtttgcacaatgacaaaatcagctaacaacacgtttctcagaatatatccagtcattaagtgatgcatggctgcatttgttatctatcctctaccagagcagggattggcaaaccatggccaaagggccaaatccaacccatcacctgttttgtatggtccacaagctaagaatgtttttaaatttttaaatgcttggaaaaaacacaatagtatgttatttcatgacacacagaaattatataaaattcaaattccagtgttaataataaagtttaattggaacacagacactcctatttatttatgtattacctatgtctgctttcatgcacttgggacaaagcctgtctagcctgcaaagcctaaaatgttcattatccgccccttgacagaacttacttgctggggaataaattctgaaagtaaagaccagctcttgttcatttagagttaattcatggttagattagattggagttcatatttactgagagactaaatatacaaatggacatggccagaccatgtataacagaactctgacctacaacctctgcagcaaccagcctgggaagccaggccacaacctctgcagcaatctgcccagaatgatcagggtttagtcagtgactgccagcttccttactttttgtcccttcctccaaccaaatattctccccaaaccaatcatgtaagatactctgcttctagttagcccgcctccagcttcctcatgccagcaacctctgatcacagcacatgtatccgaaaccttctctttttcactgtaagaagtccaaaaagctttcccattccactgcctgcctttgagtctctgccaaacactaaggatggcagcagcctctcttgcaatagcaaactctgaataaatagcatctgtttggtctcctttgggtggtctttgtttatttccagttaacccggacaccccccaaagatacaatctacactgcctatcaccatggactctagtcttaaccaggagtggcacccatgaggccccttgtgccttgctgtttgcaggctctcacaggctgtcaggtctgtgacaacgtggtaagttagcactgtgtctgattccattctctgggcattgagttctttggctgtttattttcctcttggtaataccaggttttgttattggctcccatttgtttggaggaatcaagccattccttttcatccatgtttgctcccttttgtccttctattttgcattgtgctgtctccgtgttgtttgccatgaagacaatcacagggtagaacacaggcacaggccctataagcctgttgtctaagccggctttacagactgataattctgtggttctcaccagatcagcatccacttggacaaacgtttctgtgactcaccaataaaactggataggattctccttccatctctattttctgtcctgagagcttggctctaatccagagagaacattctctggttttcttgttgggagggcgcagattgccaggtcagcatttgaaggcatccacttgtgaggtgggggctctgagacactaagcaaacaagcatcactttcaccaactgctgggacctctcatgggattatatgtaagtctaattcttctccagaaaaaaactcttgcttcttatatgtactgtcactacaatcctaattattgtgcctatcatacctcatttcatcaatgtcatcttcagtggatactctaagcaacatgagccttaaacaaaactgcttatttgaaaggggcttaggggaaaaagggaataagattgctcaggcccaatgggcagcatttttttttttttattagcatgcagaagcctccaaacagcattctgattcaaaatggttcacaaaagattatttgaacaatcttaaataacacaaactagattcatttccctagtaaattctcccccgccttgtcttttagttgcctctctatacccagtgccctcttcccccttatcctgatctatctccttctgcacctctctcaactcttctctttgtcaaaactcccttccttttcccaacaactctcctaaggccccaagatgccacttgcatttaaagatccatcccacccatgggccaggcattcagaccactgtggaatttaaaccttggtcttgagctgaatgaagagctagcaactatttatagaagaatcctagacaagaccagccactatttatagaagaatctataattcttttgagtgcatttgactcagggttaccaaactttatcaagctgcaaacattgattggaatctaaatcctgaatagcaaaagctaattggactatcccagaaaaagatctatggaatttctcttttcacaattaaaaaaaatcaagagctgagatgggaggactgtttgagcccaggagttaaaaacaaaaacaaaaacaaaaaaagaggttgaggtaggagtattgcttgagcccaggagagactccatctctctttaaaaaaaaaaaaaaaaaaaaagtgtaaaaggtaggacaaatttttctaaaagtcatacccaaaacatttccaataaaagtagacttgaccaaaaactatctactgggtactatgctcagtacctgggtgacgggatcaatcatactccaaacctgtgtatcactcaatatacccatgtaacaaacctgcacatgtaccccttgaatctacaataaaagttgaaattattcttttttttttaaaaaaaaaaaaaaagcaaatgtagaccagctaagatcggtcatacatcatgggatattaattatcaatttctattgggtaaaagttcaggaatattcactcagactatttgccacctcttttcatggtttttcagagatcattggtagctcttaattgggaaaacatttagccccatttattggaaggatataaaataaagccaccccagatgttttttaaaatagacttgaccataatacagtcataccaacagacaaaagattaaactgtaggagatttcaggctagacgagaagataaccttcaacaacatgcaagagttaaaggtgctgatctaacagcagctctttcatcttggccaaaagtactaccattagtccttatggccatgcaatccactccctcaaggacacattggctatcctcctatgaatgggtaattggaaggcccatgtgttcagggatttcatctcgaattctagtagttctgtcctgctgcacacagatgtggcaaaatattacaacggaatcatgtactatgcccagcttgtcaaaaacaggttaaggcccccttcccacaacatcgtcctaaatagcatctttataatcttcttgtctattgagaaaaaaaaaatcagaaaaaaaaaacctgtttttgaatcttgttggaagagaccttatccggtactgttagcaataaatatagcagtgaaattctaaggagtcaattcctgggttcacaactacagaagcaatgcagaattccacagaactggaaggctactccataataggacctcaagggaggattctcagagatcctctagaagtcgccagctttcagaagcacacagctgatgacctcacataggggacagcttctacccaaggcagcgggccaagaaccctgtctaattctggttttgtttttcatccacctccacgtgatcattcttctcatcttctgtagagtcctagttgttgtccactcataatggaactttttctctgttctttcctcttctttataatttttggttcagaaaatactcattcttagattatcccaaacagtacccactcctttgatcttactgatttctgaacacactgtctatcactggatccccatgataaaatcctccaggcaattccagtctcatgcaataagaccataggaaaatacagtcaatggcatctccatttacacctataggaacaaatgaccttaaacaaatcaacctatgactttgctactctccctctctgccacaaaaaaggactaattattacaatctattattcagactctagtcccacatttgaattcaacacatttcctacagtgatagtacagatacttgctacctagaggagactcttagagattcgaagatgtaacccagctaaccagatgctccggttgtaactttgtgtcataaataaataaatctttttgtcctgtatctccatgagcacctactggatactactttttttttttttttgagacggagtctcgctcttttgccaggctggagtgcagtggcacaatctcagctcactgcaacctctgcctcccggattcaagcaattctcctgcctcagcctcctgagtatctgggactacaggtgcacgccatcacgcccggctaatttttgtatttttagtagagacggggtttcaccattttggccaggatggtctcgatctcttgacctcatgatccacctgccttggcctcccaaagagctgggattataggcatgagccaccacgcccggcctggatactacttcttttatggccaagaagcctaatcccgcttgcctcagactaatacctcatgcactttaggaatcatattccaagacttgtccaggcacagggactgtaagtctataaattgctaaggctgtatgtcaactccaaaataaggccacccttgattattcaggcactccacctggggaaattaatgactcattctttatgcaaacaatcagagcagtgttcccaatgatggaaatcttagaaacatcaggaagaaacctattgctaactctggcaaaagttattaataatactacctctgccctggatggaatacagatcattcccaattcattggcacagatagtgatggacaattgcattgctccggatttcttgttggctggtcgtggtggcatgtgtgtcattgctaatactgccttttggactgggatcaaggaagtaggaaagacagaacagactaaacactgcctgaaggaaacagttacttggctttctaaggttgatcctcatggcctatgggatttgttctcttggccttggttaaacaatttgtgttcctgatttgtttgtttgtttgtttgttttttgggttttggtgggggtttttttgtttttttttttttttttgagacagagtcttgctttgtcacccaggctgtagtgcagtggcgtgatcttggctcactgcaacctccgcctcccaggttcaagcaattctcctgccttagcctcctgagtagctgggattacaggcatgcaccaccacacccagctaatttttgtatgtttagtagagaaggggtttcaccatgttggcaggctggtctcaaactcctgacgtcaggtgatctgcctgccttggcctcccaaagtgttgggattgcaggcatgaggcactgcgcccagccttgcttccctggttctaaagcagcttacagagactattaattgttctcatttttgccacagtggtcataatgttacttattgtgttctatatggagccttaaatgcttctgcacaaccagtctcttatcaaatgactgccatgattgaaatatagtttactacggagacatctggataatttctgagaagtgaagattcagattctggcttttccagaattggtcagccactcacaagccagagaacgaagaaaagaaaggactgaaagaccaaataggcaaaagaacatagccagactatacaagacaatagaacactgtctcaaaacctctgcagcaaccagcagcaagagccaggatttagtcaatgactgccagtttctctattctgtgcccctacttccaactcagggcctagaaaaggaagccaaatactgcacttttaattagcccatctgcagcttccccaagccagcaacctccaatcaaaaggatatatatacctgaaggctcccctttttggattgtaaagctttctcactctaccacctgcctgtgtcaaacacgacaagtaatgtaagcttcctctcttgttatggcaagctctgaatcaataacctctgttctcatttgggtaatcttcatgtatttccacactacacccaaccacatgcatgcacacacagttaaaaatggcagggccttgtgcaagatactagaaatcccagcagccatataaagagggccacttttcagtgaggcagtacattctcacctctctaccccacctcccaagggctcaggttcagctgctaccacctattaatatcccctcccttggctagcctgtcatcccaccactgtacccaggctttgctcagacctatgtcagggcatagccacaaatgggttaccagtatgactcccatgccatcaccctcagcaagcatctctagccaggctcatcctcatatgctcaccccagactgacatacaaatattaccatcttctgtatacgctattgtttgagaagcctaggaaagcactaaggagcctctgtgccacccagccctgggatctctcatgctgtgttttagcctctgccctgggaaggaatttgtatgagtctatagggcttcaacaaaatgcccaaatgagaggcatatgttgcttgatgggaaagagagttgccccacaagaaaatgagctaaagagtctgtggttagaaggtatttcatgctttcaaattctgagaactgtacaagctgcaatgtgagtccaaacagggagagcccttatattctcacattcccactgatggtaaattatattgattaacattagcaacattaaatcatattgctaaggctaattattataacaatacatcacctaacattaaatgaactctcactatattccaggcacaatttctaaatacttcacatttttttaatcacttaatcctcacaacagcctgagaatgcagacactattaatgaacgctttgtaaagattaggaaactgaagctaagaaaattataacaaggtggccaggtgtggtggctcacacctataattccaacactttgggaggctgaggcaggcagatcgcttgagcccaggagtacaagaccagcttgggcaacatggcaaaaccccatctctacaaaaactacaaaataagccaggtgtggtatcgcgtgcctgttgtcccccgctactcaggaggctgaggtgggaggatcacttgaatccaggaggtggaggttgcagtaagctgagatcacaccactgcacaccagcctgggtgacagagagacactctgccttgaaaaaaaagaaagaaaagaaaagaaaattagagcaaggtcatacagcagaacaggagctagaactgagctctaatctgttagacttcatactctgagctataaccgctaattcacaatgctacttaaaacccatatttgactgaccacctaactaagcaactcaggcaggatggcgtaatatgaataataacaaatacatacaagaaagaagaaatgtatcattattcagcaactaaaaagtaaattctaatttatatcaagtcagctgttaatactgtatcaattctaattagatacttgtgttgtactttgacaaatacagaatgtaaattcttttagtgcttcaatttactgtggcttttgaattaactttgcatcagcaattgtcttccaaattatttgagataaccactaatttcatataagtctattttacacaccaagacagcattttatcagcatttttcagtctcatattaatgagaatttaactaatatatgtaaatcacaatgatcctataaaatcacatgaaagccaggccgatattcaccaaaaaaatctagaaatcacactaccatttgtgtgttatttcagaagaagtaggttcagtaacttgctacttttatacatagtcaatttctataagctaaaaagaaggaggaatttgaaagtcagttgtctattcaatcttaggatgtgttacttcctaaatttgaatacaggatatgaacaacctgggacatcactgtatcacaaaagcatacttaaggctcaacaggggattagttggagagcttcttggctttcccatctcaccatcctcacccctcccaatttcatgctggaaacagacagcagcacattggtgtaaagcaagagtcagcaaatttttctgcaaagggccaaacagtaaatattttagtctttgctagccaagaccgtctctgttgtaactactcaactctgccattgtagcacaaaagcagccagagacaataaaatgaatgagtatgactactgtatgaactttaattattttttatttcctaaatgttatgtattcatgtgtttattttataaattttatttatggacatggacatgcgtatttcatgtaattcttgtgtgctctgaaatgcattcttttgtgggtttttttaaaccccatttaaaaaagtcaaattcattcttgctcgtgggctatacaaaaacaaaaggtgggactaacttggacctttgatcctcgttggctgactgctggtctaaagaggagttgtcccagttttcctttataatatcatcttcaatcaagttcacaccttgcatgcccacccctatgcacagaggccatccagtgtttttgtttgtttgtttgtttgtttttgagactgagtctcgctctgtcgccgaggctggagtgcagaggcgagatctcagctcactgtaacctccaccttccaggttcacgccattctcctgcctcagcctcctgaatagctgggactacaggcgcctgccaccacgcccagctaatttttttgtatttttagtagagacggggtttcagcgtgttagccaggatggtctcgatctcctgacctcgtgatctgcccacctcagcctcccaaagtgctgtaattacaggcaagagccacagcgcctggcccagtgtttgtttttaaacaataaatatagccaacactttttacatatgtattacttattacacttagtacttgtgatgtacttactctatgccaggctatgtgtgaaatgctttgagtataccatttaatttattcctcccctagaccttaaagatgggttccatcattatctccatttacagatgagaaaactgagcctaagagaggttaagtaacttcctgaaggtcatgaaaccagtaagtggtagggctaagaagtttgactccacagcccctgttatcagtacccactattatgtcatcctcaaagcgcttctgtgggacagaaggcaggaaagaagagtaaaaatcaaccaggatgcttgttatttgaagaatagccagcaggagacatcaacagagcaaaggctacaaccaccaacacaatacagaaagctcatatttttacatttcttttgaaaaatgactaatcctgattatctcagtcttttatttaatggtgaatactgccagtttcaatgcaataatatttcaattcaataataaactactaagcatgagggactaaaatctaactgaacatctattcagtgtcttcctagtttatacttctttgagatggatgagagcagccatccctgtattcttcctcagtgcttgcatcaagggaggggacccaggatgctcccaaaattaccaggttgcatttgtccaccacaagggagaatttacatagtaatctctccccaaaatccttccctctaggaaaaagtctccaaacttctcttcctagaatcaggaggccagaatcctggagccagggctaagcatgggagagcgggaaagggatgaagatgccaagggaaattagatacagtgaaccctagcccaaaggggctcccaaaacatcagttctgaataggtgggaagagagtcaagaaccaaatctaaagtcaagggtccccagtttgggtcaggcaaacagggtaggcccagtaggaggaagacactggtggctagagaagagagaatttttgttgaggttgagcctattgcctcattcattccttcaacaaatttgtacgaatatcactttgtgccacaactctaggccttggggatacagcagtcaacaagacaggcatggttcctgccctcattgggtttataggctgttgatggaaggcaatccaatagtaataataaaggtagaggaacatacaacgatgaaacactaaatcttatagaaatactagagggagagaatcattaagggtgctgtgttaggcagcttcgtaaattgttcctaatactctccacctcctggtatgcatgctcttgtgtaattccctctacttgattgtggcctcgatctagcaacttgcatccattgaacagaaagtaggaagttattaaaaaccatgatttctgccagcttacatcctctctttcttgctctctcttgctcaatcactctgagggaagtcagctgttgcactgtaaactgccctatggagaggctgaagtggcaaggaactaaggaagacctccaggtaacagcccatgagaaactgatgccctcagtccaatagcccacaaggaactgaatccttccaacaaccgcatggatgagcttagaagcagattcttccccagtcaagctttcagatgagactgcagccccaggtggcacattgattgcaacttgtgtgaaaccctgagctagaggatgcagctaagctgtcctcagattgctggcccacagaaactgtgagataataaatattgttgtttaaagtcagtaagttttgaggggatttgttataaagcaataaactaatacagattccaatccaggttgcccagaaaatatctaccaaactctctcagacttaccctgtttctcacaagagaaacagattatagagcatttactaacaaggcccagaatctctgataacattggtaacattgagattgatgttgcaaatggaaaccatccctctcaatgggtgaggctgagctggctccagctgtgagacaaagaatcttaattgctcccaaaaaaaaaaaaagaggtgagttggccgggcacagtggctcatgcctgtaatcctagcactttgggaggccgaggtgggcagatcagaaagtcaagagtttgagaccagcctgaccaacatggtgaaaccctgtttctactaaaaatacaaaaattagccaggcatggtagcacaaacctgtaatcccagctactcaggaggctgaggcaggagaaccgcttgaatccgggaggcggaggttgcagtgagccaagattgcaccactgcactccagcctggacaacagagcaagactctgtctcaaaaaaaaaaaaaaatgaggtgaaagaagaaagtccctcttttggcaatgagctaagagtggggcagattaagaggagtctagtagaaccagaacagagaaaagtacagtaattaaagaagtcgcaatacatgggaggctatttctaaaatatcatttgggaggcaacagatgaactgacttacccagattcggtttttcaagggtaagaagcacatgtaattataatggtccttcagtgctcccacagtatcctgatgcacctccccccatcacgatcccttaacatgcttaactcaatgaactgtttactgtcctgtttctccgattagaggcccaatgttaatatcaattaccactgtatcctagtgtctagtacagtgcctgccacacagtaagaattcagtatatacttgtcaagtgagtaaaatataccagttttgtgacaaaaaatatgcataggaaaaagaccagaaaggaacacatgaaaacataaacaatcttctactagatggaagagtatgatccttttccttgatatacgtgtctccattttgtctgcacatagacttgtctgtgcaatgtctataatgcagagaaagaaatgcctgaggatgccataagacagatcttttgggtcctacagagtttactttcataattttataatattaagattgttgccataaatttccaaactcaaagacatttatagtagattatcatctcacttgtcaatttgtcaacctgaaaactgagttcttaagcaccatgtagaaactttcaaatataagttaagatatcaacacctgcagagcaatattatgcataaagatgtaaaattaatcatttcacacattaggccccccaaaaaagataacaaatgggagatcatatcgtattaaaaataaccatgtgagattctttggattgtgcggtagcacagctctcaccaaacttcaaaatactctggaattcgggtgcagtgattcatacctatactctcagctactcgggaagctgtggcaggagaaccacttgagcccagtagttccaattcagcctaggcaacatagagaaaccctatctccaaaaaaaaaaacaaaaaacaaaaacaaaacaaaaaaagtatcggagcatccaacctagcaagcaatattgccccaaaatgcaatcaattaagtggaagattttgcatgcatgtatgtgaatttcacatttttatcctgagtcaccagatcacaaaaccagcaagctcaatcttcttgaagggagcagatcgcccgcccagaagctcaataccttccatttgggaacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactattgcaagaataaaaaaccaaacactgcatattctcactcataggtgggaattgaacaatgagatcacatggacacaggaaggggaatatcacactctggggactgttgtggggtggggggaggggggagggatatcatcgggagatatacctaatgctacatgacgagttggtgggtgcagcgcaccagcatggcacatgtatacatatgtaactaacctgcacaatgtgcacatgtaccctaaaacttaaagtataataaaaaaaaaaaaaaacaaaggcagcaatctgaaactggttctcaagattgtgctctagatttatacagatagaaaacattttttccatataattccaagttcccaaaagagcccaaaatcattcatatgtcccaagtttagaatgtcaccaaataagccagatgaattgagttcagagacaggctcccattcctgccttgtcatgactataccagcagtgtgccagaaacagttaagggacacctccactgcaacagaggcactgtgatttggcagatgtacctccattcgagaaccctggcctcttaagttagccctgcacagtccaatggaagtgtaatgcaagccacatgtgcaattttatattttctagtagccacattttaaaaatataaaaacaaataggtgaaatccatttcaataacgtattttatttaacccaatataccaaaaacagtgttttcgcaacatgtaatgaatattaaaaatcactgatactttacattcttttttgttgtattaaatcttttaaatcccatgtgtatgtcatacttaaagcggtcaattcagatagcccacagttcaaatactcaatagctacaggtggctactgagtattgagtataccatattggctattaagtataccatactggacagttcagggtaaatgcacttatcctatctgactactcaggagagaccttcttgtgttattacttatgaagatagctcatctctcatgaatttaagtcaaagccaaccatatagagatgaaaaaaaaccaaaataacctggtgtagcttctattcactggtgaaataatatatactgaacaccttctctgtgccaggcactgagccaagggctttacatagctcactccatttaatgctcacagcaaccctaagagaaggtacaactgtaatccccatttacttatgatgaaactgaggcatagaaagttaatttccctaaggtcacacttcaagcaggtggtgatgcttggatttcaactcgagcagtctgactctacactgcacactctacccactgcacatactcaacaagagggagtaaaagaaggatatgaaatgcacggttaagaaatcttagtctgacatgagtgtgcatatcagaaaagaatcaagaaagtatttgaaagcctgcgacagaaatctaggcttgagatacagagataaattcacctacaaggtaaggaagggaagggaatgaaatatgttcaacaggaaaaatagaattaagaactaactaaaattttgtgtcaacaactgatgacgacaatgatgatgatgataagaactaacatatttggagcctttgctctgggtcacgcattgttctaaagtcagtttctcagcctcagcattatgaacgttagggctgagtaatgattgtaggagctgtcctgtgcattgcaggatgttgaacagcaccccgggccccctcactaaatataaggaacagcactctactctcaattagcaaacaatcaaaaatgtctctggccattgtcaaatattcccctgggaagcaaaattgccccctgttgaaaaccctcaatctgagtgtttcatatacattatctcacttattcttgacagcagacgtctggggagacatgattgctttatagatcagaaaactgaaggtgtggttgggcagctgacctgaggtcctgtcgctaataagtgaaagagctagacaaatccaaatttgtctgattctaaagtatatttttactgctagcccccagtacaagttctcgtctcatctccaattcatacagggatttgtgtgctttcccactccctgggctgatgctagagatgaacagaaacaaaacactgctggacactcctcaccgagaagttctcctgccacaatcaccttttgtgtctcctttccaccttgtgtctcttcgctctatttggacccacgttttcttggctaatagcctttcaggaaataggcatggtatgaatgaacagataaatctttaaagcctgaatacatacttatggagaacgagtcctcaaactcaatacaaacatccaaccaactgcaattaaaagccacaaatatgtttttataagaaaattaagctatcaccatatcatctttgatataaagtgagatatgactaaaaatggaggtaaagttcaaattgctacaagttgtaaatttgttcttgaaatatcaaacacatgggaaacagaagctaattattttgtcctatttttgtatgtgaaaattacttataatctgcctgttaaacaattcaaaattattttaaatgataattgaccatcaaactaggccaatttacacctacaatccctctgaaattgcctagaaactgggacaactgcagaagaaaagaaaaacacttccatttgcgtcaatgtctttgtttttcatccatcagtctccaaggctgcaaaatcagaaaagcttaagcacaactgattaataaggaagcactttaggactttgcattatttgattatgccaagaaaaaccttataattctcataaattcattattccgatattggtcatgaggaagtctactttttaaagaaaaaaatggggaatttcttcttataacttcattgtcaatatttttaaagtattatatgatttgtttaatgcctttaagcccatcccaatgaaggaaaagggcatttgttttcgtattacaatcattcctgggtatacttaggggattggttccaagaccccctatgcataacaaaattcacgcacactcaggtcctgcagtgagctgtatagaatctgcacgtacaaaaagttaaccctccgtattggcaggttttgcatcctgtgaatactgtattctcaatctgcattcagctgaaaaaaaaatccacgtgtaagtggatcctcacagttcaaacccatgtagttcaagggtcagttgtaatttacttttaaaaaaaaatatgttagccagttgcagagaatagattcaatagcagattcttcttagtgtctcaaagatcaacttaaggagaaagaccaaaaggagggaaagcaaagcagagagggaggggaacagaaacaaagagacaaagaaggaaggaaggaaagagagagaaaggaaaagaaaaaaaatagaaaaaaagtaaggtggaaaaagaaaaaaaggggggggtggaaaaaaaccaggcaaagtgatctctgatggctcatgagagactctgatctccctatagctctgtatatcccagaatctgaaattctcaaaatcccttcactgtgcattctggaactcagggtcctcaagaacaaagatctcctataccctcaacctcttcgaaaatgatagcttccctttcctgacttaatccattcacctttccacccttgttggcaagtacttcataccttctccttcaaagcttcagcacctctttccccatactcacttttaactattggccttccttcccttttcacccagaaatggaaaccacagaagagaatttcctttacctgcagcaccccatcaactcacggacttgcatctctgcccagatcctctgccatccctcctgtaactctgggtgccccaacacgtgtgcctacccatagtagcccctcctcttgtgtactagatcccatcccacccccctgctcatggataccactgcagcagtgcattttctaccaggtcagatcctatcagcagacaaatatatcatcatgtctctcatctcaaaaaggccttctcttgacctctacttctttctccacctaccatcctatttctctccattctttatagcaaaacttttagaaaaaggtgtccaggtttatggcctccaatcagaatcaaactttccccccaccatttccccaaaatagctcttagcaatattgatgtcattagtgacctgaataaatccaatggtcaattttcagttttcatatttcctgatctatctaaagtatttgaaacaaatgatcatgccctcccttgttgaaacacttttcttcatttgaccttaaggataccacactctcttgtttcattccaactcatctactcaacctcttaatgttgcaatatcgcagtgttcattctctggccacctttttttctctatatatgattatattctatattatactcacctttttcatgactggatgcaatctttctgctaatcagtcccaaatttataccgttaggcttgctatctcatccctggactcgaaactgcaaagccaactaattaatcatcttcacttggatgtctaatagataccccaaggttcagatgcccaaaaccaaatccctgggtttaccctccaaatctgcttccttgtactttcccatcagtaaatgacaactgcatcctaccagttgcccaggccccacaccttaaaatcattcttaattatgttttttttcccatcccacaatcaatccatcagtaaatctacccagctttatcatcaaatactgccataatctgaccacttctcaccacctgcactgctcctatcctggtgcaagtcaccaacctccttcacctgtactgagcatttgtctccagtcttcctgcttctaccattaccttcccatgcttattctcaacacaacagccagaggaatcctgttaaaacatcccatcgcccttctattcaaaaaaccccccactggaatttcacaaagagcaaaacccaggtcgctaaaatggacaacaaatccttccatgatccggtgcctttccttctaatcctgtttcagacttctgatactactaatcaccatctcacatcccacatactacactttgttgctgtcactgctataattattgtctgtatgctccactagcatataagctccaggatgagagaatttttgtttgtttcattcatttatatattcccaacatctatcacagtgcctggcacatagtggatactcaacaaaatgtgctgaatgaatgaatgaatggaactctgagagtcagaaaagcatcaaatcacatctaagaactagggatttaatctcatccctgtcattatggccttactctttttttaattgtgataagatacacataacctgaaatttaccattttaaccatctcaagtgtacagttcagtggcatcaagtacattcgcattatgacacaatcatcaccaccatccatctccagaacatttttcatcttcccaaactgaagctccacacccattgaacattgaacaatatctccccattcctttctccctccagcccctggcaaccaccattctgctttgtgtctctatgaatttgactactctaggtgtcacatttaagtgcaatcaagcaatatttgccttcttgtgactggtttatttcatttagcataatgtcctcaaggttcatccatgtcatagtatgtgtcagagtttcctttttataagactttatatatataaacacacaatagaatattattttatttatccattcatccactgagggacatatatttggattgcttctatcttttggccatggtgaataatgctgctatgaacatgggtgtacaaatatctgtttgagtccctgcattaaattattttgggtatatatccagaagtggaattgctggatcatatagtaattccatttctaatttcttgaggaactgccatactgttttctgtagcagctgaatcattttctattccctccatcaatgcacaaaagtttccatttctctatttactcaccaacacttgctattttgttttttgtaatagccatcttaatgggtataaagtagtatcttactatggttttgattcgcatttttctaatgactagtatgttcagtattttttcatatgcttgttggccatctgtatgtcttctttgtagaaatatctattcaagtccttttgcccatttttccatcaggttgtttggttttctttgatgttgtcaagttatagaagttctttaattattctagatattaatcccttaacagatatatgatttgcaaatattttctcccattctgtggactgctttttcaccttgatagtgtttttgatgtatgattttaaattttgatgtagttcaatttaactattttttcttttgtcacctgtgcttttggtgtcctacctaagatatcacttccaaatctaatgtcataaattttcttgtaaatgttttatggtttcaactcttgtgtttaggactttgatctattttaattttcatatatgatataaggtaagggtccaacctcattattttacatgtcccagtatccagtttttccaacaacagttgttgaaatgatggtcctttccctaatgaatggtcttagcacctctgtcaaaaattactggatcatatatgtgacagtttatttctgggcccttgtttctttgagtaagtcttctaagctctccaacctccattcccaaaaatgtgaaatgaatagattccaccagtaaggatgtatcttattttgtcttggttactgtaacaaaataccataaactaggtagattattagcaatagaaaatttatttcttatagttctggaagctgggaagtccaagatcaaggtgccagcagatttgatgtctgctgaggggttaccttttggttcatacatggtgacttcttactgtgtcctcatattgtagaagaggccaagcagcaatctggtgcctcttctataggggcactaattccattcatgagggctctgctgtcataatccaatcacttcccaaaggccccatctcctgacaccaccacattggtggtgagtggatggaaaatacagccaaagtcctttctccaccaccctaagtatggccagcattaatgatttccccaaccaacacatggacaccatacaccatataccagatttgagcaactagtgggtgaaaacggaacatgatatgtgtttcttaaatgccttaatgttctagtagcacaatcatttatgtaatattgaaatctctacataaaaatatccacatggccatttgatctatgttaaggcacctcctccactaatggggaactcactaattttagaggaaactaattccatttatttaaaactttggctattaagacaatccataaacatacatattctttttaaatggtttgctttcttcagctatgttattagctcatttgggtccctttaagaagactctctaaagacaccaaggctggagaactaccatgaatgggacagctataaaatgagtaagaacagtatttgcagctaaatggcctgaattgcagagtagagtatgagatgtaatttggttcttagggcatccactgtaaacttggatctttgccaaaaggaaagcattatgaactactgatagacatatggcttcaaagtcatctcagttttgaacaagtaaagacagaatggaaagggttggttcagtatgaataaaacagatgaccccaaattacctctcaagagtaaattcagctctataaaaattagagatccagtggcaaggattaggaaaacacttaagcaaagctttgtacctacactgcaaagccacagatcacttggtaggacaaagtcaagaaagactcaaaactcagtgacagcaaaaaacaagatgtcaacttcagtgtattctacattaaaataaatattaacagtaataattaagtcacagtgaaacactccaagcatcccagatttctttgactttcgttcctatgatggttatggagatcagttctgattacacttttcttttagtttattttgatggaaagaactggatcatggaattatccccaaagcttcccaacctgggcgatcctccaaaccctctggagaacttttgaaaatatgggctccacactagacactctaaatcagtatctctgcagttggattttgttgtcttatggggttgtttttgtttttcttttgtatttttgtttctgttttttaaaatttccccaagtcattctgattataagcagggcttgggacctgctggtccagaccccatacctctactggttttcctcgctggaaagaccttagtaattggctctgcaaatgaagagagcaccagtgacattgggagacactactgctactgaaaatgataaactgctaggtcacatagaaacatggagaactgtatccaatataatgctaattatacagcaaatgccagatataacaccatatgtaagacttttgggcaggtaaaataataggtacagcagaaactctttcattccatatgaacagcatataaaagtggttgcaacagggcctgaagccttttgttggcaacaaggagttgcctagaactacctgtgagagggacctgcgtggttttcacctgggtggtgccattactttcaatggcaaaaactgtgattattttggcaccaacctaatattttaaaatgtgctatagtgaaatagcatctatgtgaagtgcactaatctataagaatttaatatgtgtattaaactatgttcaaattttggctatataataaataaatataggcattagagaatgtcacatcaactttaaaaacacaaaaatgctatgagctgaaattatttataattactatgaaagtgtttaaccaatttgttattattgttatagagccccaaaacctctgttacaaaattcatcagtttggtctctgtctaattctgcataatcctcaaggattctcatcacattgtgggtgttcttggcttctctttaacctgtacaatgcaaagtgatttttttaattttctaaaatgaacacactaataaaatgggcagtggaccatactaaatattaactccctgctgtttgttctctcttgtttatttgactattcagattctctgccatttgtgtctataaaacccgggattaggtcaggcagatgcaggacaatattcgttcaccatgacaacactgtcgcctttgctaatgcatccaagcccttggactgccttcgaaaatgacaaggagattttataacctctctagttgagctcttctcaccacctgaacagagacaagggtaatcaaattccatttcaaagaagaatatcattgcccttctttcacctctttcttttccaagagtgtccttgcaagatgcgtatgacccagccatcaatgctaaagagacatgattggataaggagacagagcaagtccccctttaccatctctaactctcattttcaacaatgactccctgcctgtgactagaataatgtggtgtgttagggaaagttaaaattaacagataaatatcttcttattacacatttgtagagagagataattctcaaagataattcctgttttcatcttccattctatttctccccatgatcattccattccctttaagacctttccaatatcatatttacatatacaaatcctaactcatcattttcataataaatatttatgcagcaccaacatgggctaaggactatgttcagcactgagcatacaatggtgatacagtttggatgtttgacccctccaaagctcacatcaaaatgtattcctcagtgttggacgtaggccctggtgggaggtgcttggatcatggggacagatccctcatgaatgtcttggtgccattctccgggtaatgaatgagttctcactctgtgagttcgtgctagatctggttgtttaaaataacctggaacttcctcctctcccccttcctcctgctcttgctatgtgacatgctggctccccttcactttcagccatggttgcaagcttcctgaggccctcaccagaagcagatgccagcatcacacttcttgtacaacccgtggaacaatgagccaaaataaatgtattttctttataaattacccagtctcaggtgtttctttacagcaatgcagactaacacaaatggcatccaagagagtccacagaccttgccctcatgaggcttgaagtctagacttccaatggttacttcaaattacacctcttctcagaggccttccatgattcctttccttactctacgttgtcacaatactctacccacactgtacttttggtctgtatcattttctactttgtacggcaatcacatatatatctaatctcctctgtcgatccacaaaaagtgtaggccctcattcatttttgaaccctaacagcaactcagcattcaataccttgcttataggtggcacgccccaaaaaattatcaactcaataaaacacacaagggagcaggaatgtatcaacctttaaaatcaacattaattatattttcaattctaaagagaaattacagacagaaagagaaatttatgaaaattatggagcaaagcattcagagtattaggagtaccaaaaaaaaagagtacaaaaattgtaatgcatattttatagaactcttcctgaaatgatgaacaaagaatagctcactttcccatctaaatacattgtagataaatgggaaaaagcaaaaaatataagccagttaagcaatagctgttaggttgaaagtattgatcattgggggactctattgcatgggaggagggaaatatatcaaggagtttaattaacaaatgctggagaaatcgtgctagtcaaccagaccttgaggcatgagtcagacttcacagagaaatagtgtaaaatgcagagaaaagccagactcactatggaatgatctgcagtcttttaaccacaagagtcagtgtcacagaaagaacatgacaaagcagtgcctacgatttccagagttacatgcgaaatactgtttccctgccagggaaaccccagctcatgacagtggcatgagaatgagaaaggccacctgcaaatgaaatgagaccatcccacctgcaacagcaggagagggccacacatggtcttgttagtgccatttcaggagttgtgctgcagaaccagggaggagaccagacattaggtcaagcctgtgatctcaagggagctggcctgctgcttccccagaggacttcagctagagtcagtggagttaataaatcatgtaactgtctggtcccattatctcaacccatctaccctttgattctgctgcttggaaggaattcccagaaatcaagaaacccaggctgagaacccatagatgtcattctctgagtaaacagatgttcaaaccttgaagaacccggcaggaatctgccctgcctttaactaggaagggtaggcccatctagatggagtccaagaacaggcaacagctatataaatctaacttcacaaaggttgctaaattttggtagttaaatctacagctgactgtgaaagggagccttaaatagggctgaaattttaacaatgaaaaatcatttagttaataattcctttttccattctaaaccagtgacggccaacaaaataaatgaccatgttgaactcaggaatggaataatatgttcttacaatgaaaaaaaaatccttttctgaaaacctctctcaacagcacaaaatgccctattagaaaccattctttaattagcttttccatcagcttttccatccactatattttacactgcataaaatacccatcactcaacttcttagaaatccccccactgagtttcaatggaaaaaattacaaccaactcaacactgggtttccaataatgctcttatttctataccaaaaatagaatttcacgactttcttctcctagcttgcttttcaaactaaactaacactaggtcattctcccctgccccttacctaaatggttgagtgatgagaatgttataagcgatctaacagtgaaaagcaaaaaagggcggcaaaggagagtgattggctaccttgtacactgggtttaggaggattctaaagccaaaactaggtttagaggggaagtctcacgattagtgatgtctgccatcagaaccaaaatggagaatggcagtacaatatttgtcattggggctatctataaatacaatagctggatatacagaaaataattgaggtgcattttcagtagcaagaagattcttaagttatctttggttttgtttttaagagttagctggttcatatgcaacataaacaagagttcactacctggcctaatgaaggggttggattatcatgccacagaatattacccaatgctttgagctgaggtcacatccaagattaacaggaagcactactcataaggacccctcccagggtggaagagaccatccacttaagggtggactgtgacagcctaatagagctgtgagcaaatgtgttgtgaagaaaatgcactaactgaagcacctgcttcaatttctaaatgtgactcataccatgtcagactgatccctgagctttagtttcttcgtcagtttaatgggaacaacagctcttgcactcatctcaaaggatgtgttggggattaaaatgagaacttaagtgaagcaatcagaccacaacataccttcaacaacttcagtctcactcatgggagatgttccaaaaataaatgctgaacgaggttccccataccaacacttcaaattattctccactgaaagactgtcataagaaggaggaggctgaatttcctgctgtgccctggaatgagatcactgtgtcactccatctaagttgcctggtcacaacttccaatgtgcaccattgactacatcctcctcatcagggaagggataagaacaaaatgatacctgtgattaacttctgcctagaactttatagtttatcaatcattcactctgagaagactctcacatcaactatgaggtattaccaccatttccattttaggaataagaagagtgagaaagagaaatggttaaggggttaaggaatgggaggcaggaagaaggctccagccttattctaaataccatgtcatgtctacgtttaagatgagtattagcaactcaaataagtaggtgaactgtgacaatcaaatgacaatcctgggttcactgctaccacttaggaagggatcagagaaaaatgagttttaattatagaggtagaaattaaggatattcaaagatgggagagtatactgataaggcaatcgtgcacaggaatgggttactaatgcgattatggggaacatctctcttggggggagaaaaatgtgcctgtaatcagataatttttatttgccaaattaattacaaaatacctatgggctttagggaaaacattaaaaataaccttctctgtccccgaggcatcataatatcccagatcatatctgacgggagattaatttttccatgctattcaattttaagtcaaatcaaatacttaccatacacctaatgtgtacaaagcatggtatagcagatgacacactatgcaatgtattcaagtaaacatattagaatcctgtagtgtaaataatagcaaagatgctatcctttgctgaaaggtgaagaggcacttcagagagacaagctatttcaaagaaatgattttaaagaaatgtttcaaatatcaaaattattgagatgcatgtagatttatccaggcaaacatttctatgtgtttgtacgtgaatgctcatataacatttaatgccaccacaacagtttcattttctttaaaatggttttctggtccttagtaacagaagtctgtcacatatatctttggttctccattctgaaccaagtcaacttcatggactgtttatttcattatggtatttgctaccaccaaaagtatcctctatctttcttgttggggctttatataggacaatttagaaaggaagaggtgggcatgtgcacggtgactcaaatatatctgtttctatagggagataaaaaagattcacattgactcccacactgagatgcattttgtctaaaggtactggaactcattaactctatctactccctcctttgaccattatactagaatgtgccccagcaaaatgtcctcttccagggcaaattctcagattggggaaaagtcaactagctctatatagggttaaaataaataaaaagtccttgaatatttattttaaattgttacctcgagacatgacttttatacaaagttaaaaataaaatggcttctagtaaagacaatggtggttgtggtaaaggatctcaggaaacaaggacctcatagttctaaccctcttcttcatcctcctcactggacactcaaaagctacagcaggcaaataaagtccacactgggtgccacaggcaggaagttccacctgatacggccacgaccaccctccatgatctcacctgaaactgcctcccttcagctccttcttgcccacaagtcctttctggtgcctcccactcaacacctcctccctagggtcttcacatctgctattcccttagcctagaatgttttgtactcccacccttccccatctcatcagctccagtcatcctttatatcacagctaaaatgccattcctggccaggcacagtggctcatgcctataatcccagcactttgggaggccaaggcaggtggatcacctgaggtcaggagtttgagacctgcctggccaacatgccaaaaccccatctctactaaaaatacaaaaattagccaggcatggtggtgcatgcctgtaatcctagctactcaggaggatgaagtaggagaatcacttgaacctgggaggcagaagttgtagttagccgagatcatacctctatactccacctgggcaacagagagagactccttctcaaaaaataaaataaaatgaaatgtcattaccttagggaagccttcactgtatcctacacaggtaaggttcctagttatggccccattacatgttctgatagattcccaaacacctccttccaaaccatgtaacacaattgtaattcattgtttgtgtagctgtctatttaggaactatcatgctagacaattagctcttgaaaccaaagattaaatctgtcattgtcacttctgtatttatattaggacagtttctggcacatactgagatcctaataaatttatggaatgaatgaatgaataaactgaattgaagaactcaaaaattctcaaaccaagaaattttctcctttaattctttttcccaaatcaaacatgagccagctgactgaaagccaggattagcaaaccatcagctacactgccataagcctcagtgaagatcaaagaagcttcatagcacaaagctaagggagccatctcttgaccccctgatcacctggacactacttttatgtctcctacaaggcctgggataagctacagccaaaaaaaaaaaaggaattctcttttgctcccctgcaattttactccatccagtggcctctgacctggtctccagctcactgcctttgataagtagagaattttctctactagctaaaaggcataagggaggcattctcatgagatgaacttgcttgtccaaggtcagccaacatgcccatggcaaggtttcttatttaccaaagcagaagtgaaaactatcatgttgtgagaaagaaccttactgtaggcaaaataagcatgtttaactctaaattatccagaataaaactttaatgagaatctcaaactatggagatgaaattaattaattttcttgttgaaaattcaacataaactccaaatattattaatatttcaaataaaacttttagtgaaactgttttataggtaactccagtaacataaaagctactttacaactacaggatgatgaaatcactgcacaatatattcttagctaattctgacctgtctgactttttaactttctccaagctataaaaatcaatataatctagaatatataaagaactcttcatacaaatgaacaattaaaagacaaataatccaatttaaaaatgggcaaaagatctgaataagcatttctccaaggaagacatacaaagggccaataaccacataaaaagatgttcaacatcatcagctataagggaaatgcaaactaaaatcacaatgagataccacttaataccccctagtacggctataatcaaaaagtcagataatagcaggtgatggcaaggatgctgaaaaactagaacccttttacactgctggtggaaatgtaaaagggtgcagcccctttggaaaacagtctaatagtcctaaaaaggttaaacataaatttatatgacccagcaattccaaatctagtatattaacagcagcattattcatattagccaaaaagtggaaacaacacaaatgtccatcaactgataaatggatacacaaaatgtggtatatccatacaacggaatattatctggcaacaaaaggaataaagaacagatacatgctctaacatggatgaatcttaaaaacatcacactaagtaaaaaaaaaaaagttgcaaaaaaatttatattatatactcctatttatatgaaattaaataggagtgattgcctaggccagggggatctgggagaaatagagaatgactgctaatgggtgagtttcttttttaggtgataatatgtctcaaactaattatagtgatagttggttatctctttaattatactttaaaaatcactgaattgtacactgtaaatgattgaattccttgatatgtgaattacatttcataaagctattttaaaatttcagactctaagctgttaaaaccaaagtgccagggtctttaggtaccttatctccaatcttaaatactttaacattgtctttgaatttggtcttcgattgtaatgtagtttggaaatttgtccccatccaattctcatgttgaatttgtaaaccccaatgctggaggtggggtctgatggaaggtgtttggatccctcaaagcatggtgctgtcttcgcaatagtgagttcttgcaagatctggtcatttaaaagtgtgtggcacctcctccccattctctcactccattgctcctgctttcgccatgtgatgtgccccttttcctgttggccctctgcaatgattgaaagttccctgaggcttcaccagaatctgagcagatgccagcaccatgtttcctgtgaagcctgcagaaactcttttctttataaattacccagtctcaggtatttctttatagcaatgcaagaacggcctcagacaaaatgttaaaagggaaactggagtttcttgtggcttaagaaattatgcaattgaagactgctataccttgaatgagatgtccaggaaaacacttccaccagtgggttagtatctccctttttacgtgaacagacggttcaccagagaggaactccaagtggatgctaagctaaaaagcttgcaaaaaattaaagaaatgcaagttaaaatgaaattcaatctttttggcttacaatactgataaaaagaccaggattggaaaatttgtggttaatgagggaattcacatgcactgctccaggaaacagaaatttgtacaaccatttggaaggcaatttggcaatagctattaaaaattttcatgttcatatccttttacttagaaattctcttctaggagtttattcttcagacattcttgctcaattgggtatttgtaatactaaaaaactggaaacaaaccagatgtaataataaaagattggttaaataaaaatacagtttgtccactcaatagaatatctgatggttgttaaaataatgaatggagccaggcatggtggagtggcttggaaggctgaggcacaagaatcacttgagcccaggagttcaagttcagcctgggcaacaaagcaagattctgtctttaaaaacaaaaacaaacaaacaatgaggtggtttgacatgtgctcacatagaaaggtggccaagatgtattgttcaacaaaaaaggcaagttaggatttagtagtatgtgctcacaatgttaatacattcataggaaaaataccaaggaatgtattctcagtttaatgacatatcttagagtgatgggatttccattttctaaattacacatatctttcaagttttagggtttttttgttttgttttgtttttgtttttgtttttacaaacaatatgcattagtttcacaagcacagaaaggaaagattttttttcaaaggagaacggtcccttccctttgtgtggttcactgaagcatggggaggagggtggacaggagatagaaattacaactgtttccaataactaggaatagtggctgcttcctaccttccaccataaaaagtctctgccccacttttctcatctcccacagcccttcctttctctactctcaaacttaacgactccctacctcaagccactgaagagtaatcagttcccctgcctttaccctgttagggcacaagctcctagaagacaaaggactctgcctaggttatctccacagcccaaaggacaatgtctgtacacaatgttctagagagtttcagcagcatgtcggggcttttaagaaacagtttttgttttaaaagtttttaaatggtttttgttttaaaattcaaagagtacaaaaagatacagttaaaaaatgggccgggcacagtggcatgcacctgtagtcccagctacttgggaggctgaggcaagagaatcagttgagcccagtaggctaaggctgcagtgggccatgattgcaccactgcactccagcctgggcaacagagcacatatctgtcttaaaaaaaaaaaaaaaaagaagaagaagaattctcagttcccagtagcccatcaatgaccagtgtcttggctattctttcagacaggtctacacaaatgcatgcattcctgtggccccttttccttatgtaaattgtagcatgcactctgttctgtagcttgcttttttccacttacataatgatgcaactgtttcatattggtacatacaaacatagttaacaacaccttattattttcttaaatgctttccaatgttgcatcttatggatacaccataacttagccagtctcaccccacagatatcaagtttgtgtattatttaggataaggtccagctgtactcaagataacagcggcttaaacaaaattgtctttctctatcacaaaaatctgtggaaatagatagtacttttttacaatttgatattataaagttgctctggtactttacagtatcaaatgcccatgtcttgttactccgccatgcatggcctcattcccaagttcacccatggtcccagacagctgctccaactccctcccagtgtccacattccaggcagcagaagaaggggggacaaaagagaagacatgcctttccctttaactgtaattcccagaaggtgtatactacgcatacttacatcccattggccctatctgagttatatgggcatactttgtcacaaagaaggctgggaaatgtagtctttactccagacagctatgtgcccaccataaattgagtttatatatgttgctagagtatgtgggggaaaatagaattggaaataatacagtctctcataagttacttccaatgctgtgaaatttaatcaaagcaacaaagaacattcctatgtatctgcttttgtacacttatgtgagagtatttttggacaactttctacaagaggaatataagcagctttagaaaacctattccaattatttcattttacaaatgaggtttaagaccgaaaggggtaaagtaacttgccaaagtcaaacaatagctcccagaaaagtagggttgccagataaaatacagaacacccaacgatattagaatttcagataaacaacaaataatttttaatgtaagtatgtcacaggtaacatttgagacatacttatactagaaaagtatcccttgtttttctgaaattcaaatttactgagtatcatataaatgtgtgtatatatacatatatatgtcatatatacacatacatatacatatatatacatatatgtgtttgtgtatatatatagtttgtttgtttttttagagacaggctctcattctgttggccaggctgtagtgcagtagcggtatgatcatagttcactgtaactcctgtgctcaagcaatcccctcacctcagcctcctaaacagctaggactgcaggcatataccaccacactcgaataattttgtaatttatttgagacaggatcttgctatgctgcccaggctagccttgaactcttagcctcaggcaatcctcccatttcagcctcccaaagagctgggattataggcatgagccaccatgcatggctgcatcctgtatttttatttgctagatctgccaactttacagcagaaccaggtttagaacttaaatctgctgatgtttagtcccagttcttcctctgtacaagatggccatgtcaagtgggcacaggtaataaatgaggtggagccaacaaagcatactacaaatccccaggcaaacaaaataccttcctaccgcagggctcaaacatcatgctattcatgccatatgcttaatgaattgaatttttctgtcatagatacatgggtaacaaaccagccactctacagaggttacagtaaatgcttcaatccaaaaccattagagcctgcgtacttctattcaaaataacattagccttacattaatgcagactcacagaggctgaaagtaggcaagtccttccagagttctggcttattacacatgcagggaaggatgcaagcatggactatagatatgctaagcactcaaaacacctttgaaattcacagtcacttcatagtagttgataatgtcaatgtcggcatggggaaccaagctgaaaatctcaattacatcaataaattatttcattacattctctatatatagcttaaaaaattaaaacttcactaataaattagaaccttcccatatcccttcttcatgattataaatataccaagactagataaagagtactgcagaatgtttcatataacaagattttacaggtacattttacaacaaagaaatcaagaaccttagttctaagcacattttttattccaaataatgtatattatttccctaaaagagaactaccctgaagaaataactttccaaaatttagcacaaacctctcccatgaaaaaaaaaggaacttggtttttattcagcctctagattcaaccagaaatttccaggaaacacaaagaacagagtaacaatttaaactctctgcagggatgcaatcaacaaaatccaggctggagggaaactataggacaaacaatctggtctcttcaataactaaataacaaatggaaaaaagtaagtgagccttttaaaatattaaccaacacaatgtgtggtccttatttgaattctgatttaagcaaatttcaaaaaaaaaaaactatagcacttatgagacaactggaaattgaacactgcctgaatatttggtggtattaaagaaatattgctaattttccagggcatgtgataacagtattatatttagaacttttttaaaggtccttatcttttatagatagagactaaaacatttatggaggaactgataggatatctgaaatctgcttcaaaatattagatgaggagctggtagttggggtttggatggtgtagaagtgaccacaggttgatggattaaggaaaggtgatggttatgggggctgagggggtcacagaaatagaaacactattctgtttatatttctccatgtccaaaattttccataaaatttttctagtacatgccaaaaaattaaactaaaatctgagcagtatagttataaatatctgaaatatagtaatactatatcagaagaaaataatttaagcaatttcactatttcatatcctactgtgaacaatgcattaatccaaaaccctgtgtgctgaatatttttcagaaggaagggtctgacttgactgtaatgaattaaaaggaggaaaagtattacatgctaaggttacttcaagcacatttaattttcctacaaatctgcaatatcaagaccttttttctaaaaaccaattactattttccaccaataaactgtaaacaaaactctaatgaatgactttgctaatacctgtttttactatgttcattactctgtggcccagattttagtctgatacgtaagtggaacatcaatcaaatatcaaaagagaagaaaaatttagtctgacgtatgctaagaaatctatgttccaaacttctttttaaaaagggatgccaatgagagaaaccccaacacccatactgtgaaacaatttgtatcagctttattaaccacgatcttgcaaaaaaagctactttattcttgtaacaccctctctggtttgttttttcccactagcaattgcatgaaaagggaaaagcaggaaagtcccaagactgtacaatctaaacaatgcctagggaaacagtctgtgaacttttctagctctacttgaacctatgtatcacaaaagctcgaataattttcaattaggccagtgctaccactacctggaggtataaaatgcatactgcctttttaccaataaacattgtttggtctaggcatcttgtgaagtaagtagactacacaggagttagttactcttactttacaaattaatcaactgagattctgaattaacagatttttcaagaaagagtaaaagagtggttgacttaaacccaaattccctaaaaactagtcccaatattaatccatctccccacatgtaaacatatggtcatgtataaatctttttgtatgtaaattatgctctgtaacccaatcaatatttatttctatcatcaacatccttccatacatcaaagcctactttatcatgcagatagctgcagaatattccacagcagaaatgtgccaatctttgaagttgcatagtttcattccaaatttcaatgatgttatcataaatttgcaggtatatatatctacatgaatctgtaccatttattctgcagaatttattctccagaataaattcttagaagtagaatagctgctgggcaaaggtgatgcaaaactggagcttagcccaggagggttcttgccttcacccaggaaagatttcaagggcaacctagtggtgttagactgcaacttttattgaagcagcagtgtacagcagcagcagaagcagggccaccccataggcagtgtatttttctgttctcacactgctaatacatacatacccgagactgggtaatttataaaggaaagaggtttaattgacccacagttccacatggctgggaagcctcacaatcatggcagaaggcaaaggggaagcaagacatgtcttacatggcagcaagcaagagagcttgtgcaggggaactcccatttataaaaccatcagatctcataagacttattcactaattcactaccacaagaacagtataggggaaccacccccatgattcaattatcttcacctggaccagcccttgatacgtagggattattaaaattcaaggtgagatttgggtggggacagagccaaaccatatcaggcagtgtgcccagagtggcagctcaggggcagttctgcagctatatttataatgcacttttaattacatgcaaattaaggggcagattatgcagaaatttctagaaaatgggtagtaacttctaggtcttcaggtcattgccatggaaaggagtggtaacctccctttgttgccatggtaatggaaaactgacatggcacagatgggcatgtcttatggagagatgctttcatctcttccctgtttcagctagtcttctatctggtcctgagttcaaatccccatctccaaagtcaagtcccgcctcctatctcaaagggtgtgtgcacttaagtattgattataacagcaacctgccccctaggagggctagtgcaacttacaaccccactaacagtgattagggtccatctcacttctcctcccaccactgtgtattaagctttgcatatgatagctgaaacttcggcaatatgatagctaaatataatctcattgttttaacctacacatattttattagcagtaaggttgagcatcattccctaaattttgtttggttggttgtattttttttctgggaattgtctatgcttgttttcactaatttttctactctatttttaatcttttattattgatttataaaagctctgtataagttaaggcagggttcctctacctcagcactattgacattttgggctggataattctttgttgcaagggactcttctcagcactgtgggatatttagcagcatccctggcctcgacccgttaaatgccagtggcgctcctcccaactgtggtaaccaaaaatgtctccagacattgccacttgtccttggggaagcaaaactgtccctagctaagaaccactgtgttaagtagattaaccctccgttccaattacatgctacctcctcttggatccacctccccactcagtagaagtgcccttcttctgtattccttatagatggtcattgacttaaatactattctaattttctagatgccttctcagtaccaaacagctataactgtttcaaaactcatacaatgaaagtgaagtctaaactcttttaagttccaatagtttcagttgtatcctctagaattgcattgtccaatacagtagacactagccacatgtaactatttaaatttaaatgaaattaaataaaatcaaaaacttggtttatcagtcacactagacacctttccagtgctcaatagccagaagcggcaggtggttaccacatgggacaatgcagatatagaatattcccatccctgcagtgttccattggacagagctcctctggagccttgccactcacagtgtggtccacggaccggcagtatcggcatcatctaaaaacttcttagaaataaagaatcccaggcctcaacagacctattaaatccgaatctttattttaacgagatccccaggtaattagtgtgcatcctaaagtttgagaagcacagtaccgaaagacccaaacatctgaggtcacttatcaaatgttcactcattctagaagtccatatttctccagactaaacatcctcagcctgtcatcatatgatctggattccaaatccccatcaacccaattcttcactgttctctatcatcttccagtctataaaaggacagaagggaaggctgtgcttcaggaaaggtctgaaagtgagaccatcactttctttaagctggataccatgctgctttcaatacagcctcagtgtgcattagttttgtctacatttgataatttcccatcggccacatcgcaccagaggtgcataataaacttgtgatcagcaggttccttgggccttcttcatggaacttcatggtcacaagtaccacagacttttgcacccaatgactgggggtctttaagttttacaatgttctcaaatatattccatgtaaatgactgaatcacgtaaacagtgaagaaaagtattagacctatgacaacatctgtaagattctctcttgttttgtaaatcaattaatattatttttattcttctaaattaattctaatgatattaaatttttgcagtcattcttatccttttctcattttgctttatcttttctgtctcatccctagaaattccctattcgtattgccctcatcatgcatattaattattcagtgtggataaatgtacaaatgcactaggaaaatatatgtcgaatgactcctacaaaaaaggcaacttgggtaaatcgaagatatgcagggcattagtgggtacaaaaaatagaaaaaaatgaataagacccagtatatgataacacaacagggtgattatagtcaataataattgtacattttaaaatagctaagagtataattagattgtaacacaaaggataaatacttgagggaatgaataccccattttacacgtgattattatgcattgcatgcctgtagcaaaacatgccatgtatcccataaacatatacacctactatgtacccataaaaattttttttaatttaaaaaaaaaaagatatgcaagacaagatctcctttttaagggtctaataatccagtggaaaaaagaagttttcacacaaataattataacaacaatatacagcacgtgctatataagtgatacaatcaacatgctgtaaaaaattcagatgaagaagcacccaatttctggctgggataattagaaggggaaaaaacttctcagaggaagtagcatttgtactggtttgatggatggataggacttcaacatgtgggtgggaaggtttgggagaatagtcctggcagaccaagcgaacgtacaagcaagggagatgcaaatacaaataggttgactttggccaaagtaaaggatgtgtggggagaaactaggcagaaagggccaaagcacaaaggttggatacatttgatgatgaaaagaaaaaagaatggatggaggccaggcacgttggctcatgcctgtaatcccagcaccttgggaggctgagacaggcagatcacttgaggtcaggagtttgagaccagcctggtcaacatagtgcaaccttatctctactaaaaatacaaaaattagccgggcatggcggtgggtgcctataatcccagctactcgggaggcttgagcctgggaggcagaggttgcggtgagccaaaattgtgccactgcattccagcctgagtgacagagcaagaatccatctcaaaaaaggaaaaaaaaaaagaagggatggacccagactgggcagtagccctgatcaaagtcaatgttcacacagtatctaagcctgtctattattagggttgactgaaaggaaaggaaaagaatcaatgaatgttcattcataatatataccataagacacatagatacatagcatagatagatggatagatggatggagatagatagatacatagacagatagatagatagacagatagatagatagatgaagaaatagattaaatgtgttttaaatttaaatgtctggatgctatctcataatatgataatacagatctcctccactattggatatttaggttagttcccatcttttatcaatatttaacatagaacaattgtgatgaacatccttttactctgtgaacatgtaattgctagaagaggaactgggtcaaaggatatgaacttttttttctttttttttttttttttttttttgagatagagtctcactctgtcacccaggctggagtacagtggcacaatctcggctcactgcaacctccacctcccaggttcaagcgagtctcgtgtctcagccaccctagtggctgagactacaagcgcgtgccaccatgctcagctaatttttgtattttcagtagagacgtggttgtgccatgtcggccaggcttgtcgtgaactcctggcctcaagtgatctgcccacatcagcttcccaaagtactgggattacaggcgtaagccactatgcccagccacgatatgaacatttttaagacttttgatatacatttgccaatttcattccgggtagtaagtacccatttatacctccaacatcagtatgtgggtttgtttatcctacgtggctgtgtccatctcaccgaaagaaggtgggattctgaacactatacctccttctccagtggtgtgaggagtcagaccagagtagggaggggctacagtccccagggatgtacacaaaggggtcgaggtagaataaatttcacccccttgttgtaattgtggtgactcctcacactcattaggctggcttcatgggcatggcctgtggagcacacagggcccagacttagaagagctctgtgtttgctttaataaggctctgctatcaccatcttgtaattcctaataatttttgaacaagggccctgtattttcattttacactgagtcttgcaaataatgtagccagtcctgctcacaccctacagtgcctaggagagcatgatgcacataagagacattcaaaactttctctaacttgaacagtattattgtgtttataggaaagagagagggaaaaaaatcaaactcaatctcaataaatgcaaaaactcttaattttgttatacagaccaagagaaaagttagattaattagaagtcagaaagttgcagaggaggcatggaaagaacaaactaaaaaaagttttaaaaatccagacagacaataattcagaaaaacactaagttcaaagtcaatgagaatcaggcttttctatatcatcttcccagtggattcttgaacttaataaatgtaatttctgcttggaaattttcctggaggccatctggaaaattaagacagacaggataagtgtctttttattattctgagccacataaaacaactcgtctcaagagctggtaaagactattccagaggaacccaaaccgctaatctcgctactcccaacaactttcacccacccccaaatttaatagactattagtattcctattgtgaacactgtcctttttccaagttttatttaaagcttagaagatcaaaaagtattagaattctgcagatggattcacaggagggaggccccagacttcatcaggtcagaagcattctgaggtttaagtccaagtccacttccttctcacgtcctctctaatttccattctgacattcttgagaacatgctcttaagtctggtctcaatcaaccacttcagaaccacagagggtatttcttatgaatgctgatttctagaccccacactggaccttctgcatcagcatttctgggacaagaatcagaaacctattcttttgaccaactttgggtgagtctatccacaaaccagaacttctcacacttattgtacacacacacatcacctggggatgttgtgaaaatgcaggtctgattcactaagtctaggtggaggggtgagagtctgcatttctaacaagccaagagcagtaatttccaccctgactgcacattagagtcacatggggagcttgtaaaaatcctgatgcccagaacaggtcctagcaattgaatcagaatctctgatgatgggcccagggacccccctggaacacgacagcaggtagatacaccctaaacctgtttccctgtactcccatcatactgcccgtcacttcagatgcacacactattcccccaccaccagctactcccttggccttgctaagtcctactctgtcttcatgctgcagctcaaatgtcacctccacagggaagccttctcaaccagtgtccctagcacaaagccaaaggaggtccctgcatgtatatggcttatagcaccttgaacatccttcaaagcgtcacacattttataatgatgtatttttgtgtcagtgaagaaataatgtccacctcaccccaccagcccttgtgagactcgggataccttcagtcagaggatagccctcaactcagcactgtaaccccagcagcttcccagcacttcataatagtaaagacaaacgtgtggagttgccttcctccgtgctgggctcttctctcagcactttacaaagtaatcctcacataatcctgaggtaggcacaattgttatccctattttatggatgagaaactgaagcacagacagttgcttgcccaaggacacagagctgaaggttgccagtggaggaagcaggatttgaacccaagcaatctgggttaagtaagggagataggcataatgtgggactacagagattccctggggactccctcccccaaacacacacacacacaccccatatacgctcacatcccccttccctgacacacacaattacgcttcgtaatggtcacaatgcctggagagccatcactcatccattcaaaataaatgtactgaacagtccctggtataagagggacattctagaaatatatgagtaatagatatttacttatctattattagacagacaacagacgaataagcaaagacattgcaataagtgtggcgaaagaactaaacgaggtggtaaggtaagggctggcaggctccttcagacagcgtcaggagagaagggctccccgagtgggtgccatctggctaaagcctgagagggcagtaagcccgctgtcccccaggagcagcagcaacgcaggcagggcagttgcaaaggccctaaggcacagctctgcacgcgcgcctgaggaacgcacgaggctggcgtggccaggagttgggagtggtcaagacaaagcaggtgtgacgggcaaggatcaaatcacatctccatatccaggatctcttctacccatgttgtcatcaatccagtgaccaaaacacctaccagtcatctcacacacgctcctgtgttcctggaggcctgcggctcccgtgaggcaccatgcctgctcgctcactgggccagaggcggcacgtgacctcaaagtagcccatcctcccggcaacctagggcttcgcattgtatcaacactctgctcagagtgtatgcgtgtatgcatgtgtccaggctcaccaaattgtatgcattaattatgtgcagggttttgtttttgtttgtttgttttatatttaaaaaaatataatcaaactaattgccagccaagtcagtcatcctcctgggaatatatagagtcccaaggttagcgttcctgtattagactatttcaattttaggaaaatcatgactgtgtggggaaacaatgactttaaaatgctaaaattaaaatttatgctttaactgggaaaaaaaccattgcattgtttgtttgcataccaattataccaaactaaagctagacagaaaaaaaaaaaaaaaaaacctctgctcacaaagggctggtgatatttaaatgaactgatcagattctctcaggaattttaccagaaatataagaataaggcagttggagatagggagaaaagtagacagggagagaaaaaatcatagctaggatattttaataactgactcttgaataaagatctaaaactcttaccactacagcccctagtgaccccgtgtatcttcaactccctgacccccagctataccttggttcctattatcagatttctagaagattccagccctcttaataccatttgtgtaataatggcatctgttgaacacgtactctgtgctctgtgctgtgggctttccacgctatctcatgtagtcttcactagaaagtgctgaggcaagaatcactatccccatttttacagctgaagaagcatctctaagaagttggcttacccatagtcataagctgttgtgggcagacctgagactgcaaaagtctgtgctgttcctattttcttaaaatgaagcctcattaccccagttggcctgggtgaggcttttttccttataacctgaaacagagttatctttttcagtgtctaagtattagtgccagtaattaaaaagcgatggctttcttaaaaattatatgcaaagctgtatccaaaatgtcaaattttgggatatatatagagagcaaactgatcttaatttatgtccctgtgatataaaacataaatttagtaagtgaactttggtgaaagatttaaacacaagcaataaagcatgtattcattaaatgtaccacacaatatgatacataaatatcaagccatatgaataaattaacaaaattactctatagagagctcttcccacagcacgatattcctgtaataataactaacatttactgagcacttactatgtgccaaatgacgtgctaagcactctgcttatagtatgtcatttaaacctcaccatgggagaaacagtaaaataacgccagtttacagatgtggaaacagaaactcgaaaagaccaaatagctggttagtgatgtcaagaattttgagttttctgggggggttgtttttagaggcagttttttgtttgtctgtctgctttggttttggtgtttgtttggttttgagatagggtctccctctgtcacccaggctggagtgcagtgatgccatcatggctcactgcagtagaggcaagttttaaacacaggtatgtctgcctctagaggccttgctcttaactactccaagtatcttgattacagcagatatcatactatgttgtgatagattatctgaaagtctgtcttccactatgttcccaatttcaaagtatttacatcctctccttttcacttgtccctccttgcccaggatacagtaggaatatgatatttatatgaatcaactagctgatctattagtaacacaagacttagaccaataatcattcctgttgaatcaagactattgggtgaattttgcaaggtgatgaattatctcagaaaaaaaaaaaaaaaacagaatccagaaagcttaacctcaatttagttacaaaactcaaactacaatcaattcccaagcagaagactgttgagtttttaccttcttattaacagattgatttgtgacaattctgtgccactcagaggaaagagaaaaaaaactgagatctctgaaaatctctcataaaaattatctgtaaataacaagaaagatgtcgaaatattaacgcctcctccatgagcacatcaaaatgctccctctgccaccttccatctgcttgcctgcctcacccaacgtgagcacagccccactctgctttcagcttctcttggatgtctaaaaagactgggccaaaaattgtttcagcacgccggaaagtataatcctcacatttcagacacatttagataccctaatttaaaatatggtggaaaatagcatacttgcaggctgttccttgctatagtttaaatgcatccctcacaaaattcattcctctgttaaagtcatatgcataaacttcacttctaaatggaagtaacaacaacaatagcagctaacacttacatagcattgttctcagcactctatatacagtgattcatttaatcaccttatgacactactctttttagcaccattttatagggtagaaaactgaggcccagaagggtttggtgacttttccaaagtcacagggctggtgagtagcagagccaggacttgaaaccagagctatgaactccagatactatattcttaaccactgcaccaaactgcccagggggcttcagccactaactagcttaatcctttcttctccaagatccctggttgtcatactgcaacagaaaaaaagctggagggtgagtgtggttgattgaatactggccccaaaaagcatatgtccaaggcctaactccctgaacctttgaatgtgaccttatttttaaaaagagtcattgcagatataatcgaagttaaagatctcaggatgagatcaccctggatttaggacaagccctaagtccagtgatgggtgtccttataggagaaaggtagagggagatttgacacactgatacacacaaaggagaaggtgatgtgaagacagaggcagagactacaatgctgcgtcaacaagccaagggctgctggcagccaccaaaaggagagaggtatggaatgtattctccctcagagccttcagaaggaaccaaccatgccaacaccttgatttcagacttctggcctccacaaactgtgagagaagaaatttctattgtttcaagccaccaagttagtggtagtttgttatggcaatgctatgaaactaatataatgagtcatggatcaaaatccttcagcagaaatccacatccccactctacagatcaggaaactgaggctcagagtgaggacttcattggcacgctgtcaagcacacaaggggtttgtggcagagccaagccaggctctaggctacatactgggtcttcggacatctggactagccccttcttcagtatctcatatctaccactttgagagacataatcatgcagtgttcacagacgggcactttagagtccaaccacctgggttggcttccatgtttggcacgatttgtgagctgtatacctcaaatttctcatctgtaaaacaggaacaaaaatgacacctacatcacagtgtcattataaggagcaagtaagtcaatacatgtgcctggtatgcagtaagctctcaataaatgttagctattactattattttattctaatatctacttaattatagataaaggttaaactataaagtcaggaatatggcagtgcctagaaaaaaatggatagacatattaacaggatttatctttacgggtgcacatttgtgacaaatgctattaactaatttcttatgtgggggttggacatcaagaggtaatatctatcaccctcaacttacacctcttagccagtccttactggccctgatggaaaaaggagtgcctaatatgactagccagagaccaggacattgactaggacatgctgtgctggtggacagggtcactgtagtgcaaaaggcccacagctgtgcccctcactccaagctgcggacccgaacaaggcaagccagccccaagcctcccactttcatgctctggcatggtgaccactcctggaaacactgcttccccaggcagcactgccatccacccagttttccagcctctcaggacagggccttgccaagtcacctttattctttcacttctgggcatccatgtggtaagcacactacagcctcctctcttgctaacctgatctccccctgagcatggtggctgcttggggtcagcgcacagcaggtatggccatcttgggtcctgggaatggagggagtagcaagcttccttacctaatcaaaaaatccctgcatggaaggacactgagcccatcctcagaattaataaactcatcctccgtcttccatttgactactggtctctaagtgcatagtccccttggtcagacactggggagaggaaaaagaacagtggcattcagacaccaaaaccccacccaaactcctaacaaatttatattaccttctgatggaaaatgtgtatgataagctatattttttcaaagaataatgctcattgcacagtgccttctgacttattgaatttcctaacactcttctgaatgatattgcaggtttgaagaataacaagaacatgaaacacctcgggaaatttctcccccaaaccaaataaccaccaatctgttgttgttgttactccgctttaataatagcactgggcctatgcacacatgtgcacccatagaaaccacagcccttgtctgatcacttctaccccaatataaaaatccaaggtagttgctggaatgaagataaatactactggaattaacagtgtccttaggaaaggcagggttgggatgctgatttcatcacaattctgcctgtactttttcaaggaagttcaagaaccatgggcagctgtagaaatccaagtcatcagaaaagcaaacaaaggcagctcctcccccgcaaagcatgttccctggaagggcctctgcatctgccttcttagcataaagtagtggtggcaccttaatctactgggaacttttctgcctttccttttgttccactcgaggccaggcaccagactttcatcattatccataatcatgtcaactctctgacttttgagaattaaccaatgcctgctacaccttactcttttctccttccctagatatccaaaacaaggccctttcccattttctggttctgtgggggtagctcttaaattccttgaagtcaagagaattattaagatgtcccttctggttgggcacggtggctcacacctgtaatccccgcactttgggaggccgaggtaggtggatcacgaggtcaggagatcgagaccatcctggctaacatggtgaattatttagactctactaaaaatacaaaaaaattagccgggtgtagtggcacgtgcctgtagtcccaggtacttgggaggctgaggcagaagaattgcttgaacctgggtggcggaggttgcagtgagctgagatcatgccactacgctccacccagggcgacagagcgagactctgtctcaaaaaaaaaaaaaagaaaagaaaaggaaaagaaaaagatgtcccttccactctctctctctccctctctgtctctccccccaggtacagagttttcactcaggactctgtgagaccaaacaacatccatattttaccaacatttcgaatttaaaaatgttcttcatttcacctttaaactaaaaatgtacatctgtcaaccaaggggtggaccagaggaacacggagagacaatgtcctacgtaaggtaagcagcaatgcttagctccagctcactgggctcagggctaccacatctttctggtattcagggaaatgaagaaatgcaggtttttacatgaagtcctccagttttcaatcttaacaactaattccccaggtcacacagccaacttgtagcagagccagaattggacctaggcatcctggcctcatgagctcaagaggccttagctctgtatatatttgtacctttcattcaacaactgtatactaaaaaactgctatattcaggaatgttattttaatgagtggatggatggatggatagatagacagatgggtacacaccctaatatttattaaggaatgaagggagaaagtaaaatataatttccaaatttacaaaatattttttaaaaactgagacaaaacattaactctataactatcatttttcttcctaaaataattttatttgtaattgactctgaatagggaatagatcacacagtccgaatgctgaaagtaagggaaatatagaaattgtatttaagccagggcatctgccatttaagaaagccatgagtaaggaagcactgtagctttggaatccacaggtaaaaccttttcttggattatttaagaacaacctcttttcccctctgcactcttgggaggatagggtatatttctgtagcatttctatagggatggtaattagtatagctgagaaatgccatcaacagcaaaagtaaaattagcctttacttgtaaaattttctcctggggaaatgctggtagctcctgtctccaccaagcatggtaatgggcttgctgtgtcatcccattgcaagcaaatcaccccatcagcagcgcttgaatagaaccaccagcacaacaaataggacagccaacacaaatacttttgcctgcttcaactacatctgcctcaccctggccccatgccctcatcaaatcgcactcatgagtcataacagcattgactttcttttgtcaccaaagcactcttaattttcctgaaaatttttgagtggcttggagccatgacacgttttaaccaagttgagccttggaaacaattgtattcagtatgatgatgcagcaggggaaactgaggtccagggaaaagacgtgatttggccaacatcacatctaatttggcatcaaagccaagtctaacttaattcctagtaggggctttctctttttgatgtaccaagcagtctttttaggttaaaatttacttctactccacacctactaatgtctctttatctggaccttctctgaccacctcctcctgaggtttgaagaatagaaatctcacctcctgcccaaagctgatctgtctccctactcttccaggcttggttccatgaaaaacccctcttcatactggcccattccctacaagttaaaaatatggtcaactatgtcacacaaagaaggcagggagagattccccaaactatgcatcttgttcagttaccacccttcaaagctaacctccttgtgagaagagtataaaaagcaacattaacacttccaagccactgcagccccaaatccaccctaaccatgccatgatgatgttctggcagagaccacaagaacgcaaattccaccaaacccacctccctactcaacaacaccacttggataaatgacgctttgccaacaacaaaacatgattaaaaaaaaaaaaaaaaaaaaaactcctgatctctctctctaaactgaaactgttttacccttggtcttccccagtggctcaagactccttttagtacacccacaagaatgaaagctccatacaggcaggaagtttttttctattactctaacctctgcacctagctcagcacatggttccatgtttattgacttaatccatttcagtcattcagtcatcatattgtttgaccttctggggtggcaccagtgaccttgccagtagaaagtaggtagacatatctaaaggccggtgcagagatctaagttagagaacttgactggggggatcatttctttggtacaaactattgaagtgtcattataagagtcttagctggccagatattatgcagcagatggattctgtagactgagatgagcaaaataggccaaagtttataaaaaccaatcaatcaaacatctcctctgagtcctatgtttctagctggttggattaatatatatagcttgctagatctggaaaccatgtgatctttctttgggcaacataagcgtctgccttttctgaggattcagataatagtgtttactgggaaatcaccctcatctttttttctattactccctacaatgatagtgaatttatcgtttccatctcatgccgtgggacatatttcaatgtagcataccagaaaaatgtaatgtgagtctttcctttttttttattttttgcacaagaaaagcctagctgtggctcagaattgtccagggcagccatctgaaaattaacacaaactggcttggatccagttatgggagtcaatacctatgtcaagaaaactctcctagccattcctaagcagctcatctgaacttggtttcaagagtagggtattctaattccactgactctataaagggtaaagaacaataggataacttaaactattaccacatctattttacaggtaaggaaacaagtgcagagagataaagttaaccaaattctcacagctagaaaggaacctaggtaatccatctccaaagctggtgctctcgaccaccatcatagaaaacaaagcaggaacccagaggcaggctccactaacaccatgttgccagttctgctcacagaaactctttgaacaggcagcatatcagatgcaaaggcaaaaactagggctactaggattacaatgtaagcatcatgtagtaatgtcactacatgtcctacaatgagggtaggaaacatctgataagtgttaagtagggttcaagattagcaccaagttgagactatcccatttaggttcatcagaagtactgaaataagatttggaaaggggccggggcagtggctcatgtctgtaatcccagtcctttggaaggccaaggcaggaggatcatttgaggccaggagttcaagaccagcctggccaacatagcgagaccctgtctctacaaaaaaaaattgtttaataaaaatattaggtgagcatgttggtacatgcctgtagtcctggctactcaggaggatgaggaaggaggattgcttgagccctggagatcaaggatgcagtaagctatgattgccactgcaccccagcctgggtgatggagcgagatcctgtctcaaaaaaaaaaaaaaaaaaaggattcggaaaggggatgacttccttttacatgggcttcaaagttgtttaattcagagtcctcacctgtcctaagatcctcttgtgtacacagagctactcactccatactacagtcaatcctgacactggagactgactttggagttagtctgcctgggttcaaccctagctttgccacttgctaaatgtaactttttgacaagtgacctctcctctgaggcttgctttgctcacataaaaataaatacatataataataacagtacctacttcatagggtcattatgtggattaaatgagataccatatatgtggcctttggctttatttcatttagggaagtactttacaaaccacactgattgtttattattcttacttaccaggggaacatattgtagttaggtgggtacactaaatgggaaagtgaagtgattcacagactttacatgctggcctgagaaaggcaggggctcaggccttccccaactcccccatcccaaacacttccagaagccctacactggctggatgttaggaggatactgtgcccactcttagactctggctaggcttctacagaagacagagagaggtcacatcaatggctcttccagaaaggtaaataaactaggcaagaagctttcttccctagaccaaacttcatgctcaggtcaagttccaaggtagagtcaactacccataaccaacaagatatatcactgcttcattccttattcacagtctacatagaaaaaggaaatgaacctctaaggattttcacaagatggtaatgggacagaaagtgcactttacacttctttagtgtcttcttcagcccttggcatataactgggaacatgataggtacgtaattaaccctcacttgataattcaacaaaatcattcgttccttgctcttatcacaaatgcctacagcataactgcatttgtagtatgagatttgagttacaattacaaataagtgatatagaattgccagaggtaaacttggaattttcgtacccagagacaagcataatgaatggaaagtccttaatgaaaatatttaaagatgtgcttttactatgtgacacctaatgctatgcaaactctttcaaggtaacttattcctgaaggtagactaaaatccaccacctccagtatattgtatctgaatacacttagtgaatgcagtacagtccatcagcaagtttccatcttaccaatgtacataccctttatcaccaaaatcctggcacatgccccctatttctcagcacaaactgaatagcagtgaaatgaagacatgtctcatattaccaaaagctcattcatttcactaatcactgggaactatttactcccaacacatgtgcaatattttatgaagtggtaatatctagacagaggatcttgatctaaatatcctgagatgcccttcgagtttgcagtagggatgaggaagtgaaatttgtgcacaatccagattatgcacacctttctagggaaaattatgacattttcatcagctctcaaagtgtacatggcttcccaaaggtaaaaaccccgaagagaaatttaaaatttttgagaaggcaattttatttattatttggtacatttctaaatttaagcaagttctaaatctggccatcatgtgcactgtccaactctccatctcataggcttattgatttctattggtcttaggattccttggaaacttttatattatttcacatggatattttagaaagattttccaagggatgaatcggtgagttttaatttctttccattccttctcagataatatgtactcacgagccaatcgtttttagaacttaagtggttatacttttttttttttttttttttttttggagacagagtattactctgtcactcaggctggagtgcagtagaatgaacacagctcactgcaggcatgacctcctaggttcaagtgatcctcccacctcagcctcacaagtagctgggaccacaggcacacaccaccatacctggctaattttttagtaaagacaggatcttgccatgttgcccaggctggtctcaaattcctgggctcaagtgatcctcccacttctgtctcacaaagtgctaggattacaggcataagccaccatgcctggcccaattatacttacaacgaaaaccatcaaattattacttacttctaaaagtttacagatcctaattagtatcattttcccatccactttggagaccaaagtctccaatgaaactaagggaatttgggggccgggtgtggtggctcactcctgtaatcccagcactttgggaggccaagacaggcagatcacgaggtcaggagatcgagaccaacctggctaacacggtgaaaccccgtctctactaaaaatacaaaaaaaaaaaaaaattatctgggtgtggtggtgggtgcctgtagtcctggctactcgggaggctgatgcaggaggagaatggcatgaacccaggaggcagagtttgcagtgagctgagatcgccccaccgcactccagcctgggcgacagagcaagactccgtctcaaaaaaaaaaaaagaaagaaagaaagaaagaaactaagggattttatagaaagtggagactgttttaattccatcaaggatgcactctgatagtatataaaagcgccatgtgggtccactatggtaaaataacatgaattgatcctggtgttggtcaatataacttccagaatttctctagggggcacaatgtaggtagggagtgaagaggtgagtgtggaggttagagattccaggaggctactgaagttgttattgaaatggctagttatagacagaagttaactagttatagacagaggttaacagaagctaactattcagactataaaagtcttctggattcgtcttggtcctcctaatactagaactaaggcaagcttctaactatgtgttgcacaagcatatttcccagcaatggctgtcctttcctcctcaccaccttacccacacactcccttgctagagaatctactcatcatgcccctttctcagaaagaccttttccatagctctgctgagggggcgtggatgtgtgactcattcccttggccacagctgactggacctagaagagactagacccaagctaggtcaattggattattggttctctgaatttgaagtcgcaacagcgcaactctaggctgtccctggtgagcacttgaatgaagaagatacacatgctttccttgagtgccgctttttcataagagatatataaaaatagatattaagagagaaaataagagtgatagagatgtgtatgtgtgtataggagagacagagcagagacagagatggagactggctttgttgatattcctcatcatcttccaactgaccccgattcccgctccatgtgacacctggctgccctacttacccttaatgtctagtaggtatcattatgtgctcccagtaaatccctcctccccactttttttttcttaaacttgaatgggtttctgctacttgcaaccatattctcccttaaatgagggagagtggataacttagtaaataaatggtctggattctcaaaaagaacaaaaaagatatttcacaggggaaagttgctggcagaggcagaaatcaggaaggctgggacccaagagaggaagatctgattttgagacacaagatgtggaacaaaagacaaagcctgcatagtgtatcaccccagtgaggtcagaaaccaactgaggaggaagctgagaggtgcctgttgaaggccccctggactaggaggccagcgaggtactctgaaattcctgaagatagaggcaaggacaggaggaattctaaatgattaatgagaccatcctcattgaagtccaataacccaaagtaaagagctgccctgtccctgaaactctgctcttgtagattcagggaatttgtcaaagtcacaaccacctgaaagggtctgccaggcctttaatgagcatcctgagagataatctccctcattcctttgccacctgtggttttaattttccagccagtcctggagttgcttcctcccatccttctggatgggtttccaagacaggagtgttcctttggcattctcctctgctcatttacttgacaagaatgtgtttgctacctcctgctggccctccctcctcgcctgttccttgcttccttcttcgttcttgctctctgtcctttctgtatacctctttgacagcatgctgaagatgctgtcaggcaacacattgcttactccactctatcttagagcttccatttcagccccagattccttggttttcaagcaagtttgatgtttttcccttcaagacagtggaaagagcacaattttagagctaagcatacctgagatcaaatcgcagctctattggtgaggcctcaggcaagtcactcaatttctctgtgacctgtttctcttgcataaaatagagatgccatgtgtcttgcagggctgttgagctcacacatggaaagaaactagcaaattcttggcacatagaaggtgctcaaaaatgcttacttcccctccccttttgtcagacatggacgaaaaccaccataaagtcagtgaaagtgtaaagaaattatagttttataaaataggtttatttcctttatgagttgtccatttccttacaagattgacacctatttaccaaatgtctacttctaaaagaattcaagatatttgaagattcatgattaccaatccataattggaagaatacatttttaaaaagacatcattgacaattcattctttcccacacaatgatgaatcatgttttagtttttatatcatcatttttacaaaaatacatgcattttgatcatcagttcacaaagtgaaagtaaagcactgagtgaaggcaaagcatgatatgcaaaatgaagttatagtaatcatctagttaactcagtttctcaaccttgtatctactggcattctgagctagacaacgtcaggggctgtcccgtgcactgtagcatgtttagcagcacccctgctctctactcactaaatgccagtagctaccatcccccaagttgtaacagtcaaaaatgtcttcagacactgccaaatgtcccctggagaaaaaactgcccacagttgagaactaccaagttaactttatcaacgtatggagacaaacgagacagctcacgcccagccatgggtttgtaagatgaaaagtagctgcctcagtctttacttctcaccagatctttcctactgaaaaacaaaatggctacacgttgcttccaaggcacaatcaagcactggcttcacagagaaacagaagaaattgcacgtgccagaattcggttgttagactgccccagctcttggctgcactcccacgctctacctaaaaacctacttcccaaacttttgaaatgctttccacagctttcagaacctgacctttacaacagctttatctgtgtgtctgtgaaatagatttacaattttctatgttcctgcgaggccaaaccacttattgagtccaaatgccaactgggggtggtgggaatttgcacacagatgtcaatggactccgaaacaacaacacaagagctccacctgcaactaattatagaaactgaaattgtgttctggccagaataggccacattcagaacccaccccatctgctttggcctgtaaaatcactctgttacttttctgctgtcaacatagacttgactcttaaaattctctgaggatgctgtcgatagcgaacaacagtgaatattttgggggtgaatgttttgggagtgaccactcctcctgcctttccctcttggagcttggtttcaataagtacccttggcgcaagtgagactaaaataatctattcattgaaataccctgattttttttttttggtggcttatgtgctgctgcaatcccgtcacccaaataaagtgatccagagagaaaaatggaagatggaaatcatttaggtctcccaaggtccagcacacaagaatgtttatttccctaccattagccaagtctttcagaagaaaacctgggaataaaaatctgtaaggccactaatgtggtacacatggctgattctagggccgactgcaagagattactgaggccaaaaccagctgacatctgtgacaaagatgtatagttcacttcaaatcattatcctaccttctagcaaacaaagaaaccagctcttggctctgtgccatctcatctatcttcaaaaccaaaagaagttttcactcatctctgaaaggcatttaaaattgtagtttccatctaagtaggtcatcatctaagtctggaccaaaatttttccagctctctggaaaagtagacaaaagctacagttctctgaagagctaaggaagactgtttcaagatgagaagatggactcatttttttgtccttctgagattcagcattccaaggtatgttgtggtgctaaactatattatccagttctaaatacgtgtgtttatgtaacattggggaaaacacacacaagcactcacacttcaactcggaattaaaatgaaacaccttacacacagacgcaacatatgattgacttcttaagttctcaggccccactatgactgataagcccttaaaacatttggagagcagaggtgagtaaggacagctcaagtcaaggcaattgacatctgtttttgtcttggagcatctggtcgcccttcatcccacttcctttagagaactgctcctctctcaacacctgcagttctaatagggtcaccaatcacagaaacctcttctcacataactgccccaaccatctccccacaaaacacacacacacatacacactcaccaagtcctggagggaggatatgaccaaagcaggaacagagtccctccatgaactttccaagtaggaagtgaagatgtaaggctctcttgacctttcaattgtgaccctagggtactggcaaccaagaccgcccaccacacagaggaaaaaatgagggtcacacatagacagaggcagacattgagaaccagagatgaagcaatggtgagagacaaagtcctgctacagtttaaggccctggatgcagtaaccccaaactccacacttgatcctttctgcaattttgttacaagaactaaccaactccaccccgaccctttttcttttttttttttttttttttggcttatgcaggctttgagcagcatttgtgtcactactttggagtcttgcccaaattaattagtaaggaagtttcttcatttgaatgtgtaaggtcctttaagatttcattgaacctccctgaaacatgccatggcttgttggggtggggggaggttatcaggactggcaattactatgaataacagttatcaattaacggtttctgatgttttatcaattggtgagctgcaagtaatagaatgaccaaacaacagtgacttagacaactctgggtttattttctcacatgactagacatctagaggcaggtcattgctgctgttggtgcaatttctcagagatggcagctcacacgtctctggacttgtctattgctttctttctttggcctttctttcatggttataatgtggctgacacagctccacccatcacatcaaccgtcaagacagaaagaatttgggaaggagaactgctggtgatatttgttcctttatcaggaaagaaaaagatttcctagaatctcccagatttccacttgggtttcattggccagatacttgaggaagaggaggaggagcctgaagctgagccaggatttctcagacttatactagtggaaagaagggagcctgagagaaggtaagggataagacaggtctgagaagtgagtacatctgagtcgctggcaccatcaggacactttggaaggcccagacgtggaaggaaccacatagaaagtgctcatccaccttcacagatctcctttaaggtctcacttcgagatgctcctgaagcagagcagcctttcccaaagtgtggccttatacccttatttctaggaatatttataatttgtaacagatgggactgttgttaaacatatgtatgtatattcattccactccccctctgccttggcagggagtaaatttcctctacatgactgactttgggcttggttacatcacatgctttagccaacagaatgttggtgaaaatgatgaaagccaaggctttaaccatgtttgtggggtttagttgtacatttggcatctgtgatccaccatgagaagatgaagccctgaatagctgctgttctgaggagaaggtggagacatggaacgtacctaaacccaacctccagtttaacccaactaagttgtagccaacctgcagatatgtgagggagagagataaacgcttgtctttttaagccataggttttgagatggcttgttacacagcattattgcagcagtagctgcctaatacgtaggtgcttagtttaagttttggcagagcgcagtggctcacccctgtaatcctagcactttgggaggctgaggcaggtggattgcttgagcccaggagttcaagaccagcttgggaaacatggcaaaacctcatctctaaaaaaaaaaaaaaaaaaaaaaaaattagctggatgtggtggtgtggtcccagtactggggggttgaggcaggaggatcacttaaccccagggaggtaaaggttgcagtgagctgtgatcatgccactgcactccagcctgggtcacacagtgagatcctgtctcagaaaaaaaaaaaaagaaagtttcacagtggagtaagattagaaaattggtgagttaagcaactttaatacatatttttgtttttcagggattttttgtttggttggttggttggttggttagttggttgattggttggttggttttgtagaggcagggtcttgctatagccccagctggtctcaaactcctggactcaagcaatcctcctgccttggcctcccaaagtattgggattacaggcttgagccactgcacccagcctagtaaacatttttaactgaaagagagcatttcatgtggtgatatgttgtagtagtctgcttatgttgtgggtcgaattgtgtatccctaccctcaaaaaaataccagtacctcagaatgtaaccttctctggagatagggtctttacagagatcataaatgaagtcattagggtagactctaatccaatatgattggtgtccttatgaaaaggagaaatttggatgcagacacagccacccacagagggcagattatgtgaggacacacagggagaagatgatcaagcactagccaaggagagaggcctggaacagacccttccctcacagccctcagaaggaagcaacctgctgacaccttgatcttggatttcttccctccagaactctgagacagtaaatgtctgctgttcacatcactcagactccaacatatctttttgtgggggatatacaattcaacccccacaaaacgtatgcattatgaatttccaggataagcatatccaatatgttgggtgttaccatggactgaccagaaaatccgttttgaaaagtgttatctccctgcacacactttggaaatactggctttgaaggatccatggtttcttagacttatagtggtagaaaaaaaggagcctggaagaaggtaagtctgaggagtgagtacatctgagttccacccacaaacctgatgaaattctatcactcacttccaattggcacaactcatcatatctggacactcacaatgaagttagtattttaatagaacatagttgaatgaccctgttgaaatggccctgcaggctgggggcggtggctcacgcctgtaatcccaggacttttggaggctgaggcgggcggatcacctgaggtcaggagttcatgaccagcctggccaacatggtgaaatcacatctctactaaaaatacaaaaatcagccgcgcgtgctggtacacacctgtagtcccagctactcgggaggctgaggcaggaggattccctgaacccaggaggtagaggttgcagtgaaccgagattacaccactgcactccagcctgggcagcagagtgagactcagtctcaaaaaaagaaagaaggcagaaaggaaggaaggaagggagggagggagggaggggagaaaagaattatttgcagttatacaaataaaacaaagcagtaataataaaggaaacacagaaatgtgatccatctcgatcttttcaaatttcatgttcaaaataagaatcaataaatcctatgttgaaactggatcaaaaactcatattaatattgatttagagtagattctttcctaatgtgttaagccaaaaatagaaatgatcacataaccattgtttaaaagctgtaacattccccagacaggtttacttacacttcttgggttacgtttcccaatgaccttgtcccacttctgcacacgcaagatgggtaaatattagatctagtacaatctccgagtgtgtggtgctatttatattcatgcagagccttggctagccatgcacaacctaggaaaatgtctaaaaattgctttatgtgtacctaatttggaagaaatccgttagaaatacaacgttaacaattgcacaaaataccgaggaatatgaaaagtcagtaactcttatgtaccaaactacaacacagaagtttttataaaccttaaaaagatgtattcactcctatgtttcctctctttgatctccgtaacacaatagaataaagatataaagaaaagataaacctatattcttttagagaaaataggttcactttacttcccaacagttgtatccaccctctcatcagccctgccccccataacacctatcccaacagcacaggccactaaaaataataaggggctacctcgcgtaacagtgtagtatggcagcagaacatcctttctcaatactttctcctcatccctcccccaactgttctacaggtgtgacattgagagcatgggctatgggttcatggcattccaaagaatcagctgtccataatcccttgccccactctcctccaatttaagaaaatatatcatgaagcaaaagcacaagtgacagcaccaagataacactgcatctgtgcaccctggtttatacaccaagataacactgcatccgtgcactctggtttatacaaacaagcacatgattctaaatttcagtgctgcaactcttagtagtagagcaaatgtatttatattcatgtagagccgcgtggctgagaagtagggccttggagggaactgggtggaggagaagtgggaatggaggaaggggtggcatatccatccaagaaactgagtgtcaaccctttgcacataagaaatttggtcacggccacctactcattagctccaaggttccaaatagtcctgcactccctgtaacacagagagggagttcagcatcctcccttagatctggagttgggttcagctcccttagacagaaccatgaggacttcaaaatctactgccaagaaactgatgagcaggagccctcgacaacgctgcatataagaaggaaagggctgggttagttagcattatatttataaaactatgaacttcctatacaagagcatttcaatctccttacctctaccctgtaatggacctgcttccaatttctcttcacacagaacagttcaaattgttttagatcattagaacttaggttagtgaaattctaaatatctaaatacccctgaaagaattaccttgatagatgcaatctctgattattgtggataagaaaccacaatcaaatgtcccttatcccttttgtatttctttcttccatatagaaaaagtttccatgatttttcctttaaaaggaaattaagttatggtaaatggtgaaaaccctaaacagcacaaaaaccatctctaggaaaaagaaataaattcctagttaagaatacaaattctggccaggtacagtggctcacgcctgtaatcatgccactccaaagagttagatgtccataatcccttgccccactgtcctccattttaagaaaacacatcatgaggcaaaagcacaagtgacagtaccaagataacactgcactttgggaggctgaggtgggaggatcacttgagcctaggagttcaagaccagcctgggcaatatagggagactccatctctacaaaaaagtacaaaaattagccagacatggtgacacacacctgtagtcccagctactagggaggctgaggtgggaggagcgattgagcccaggaggtcaaggctgcagtgagccagtatcgcaccactgcactccagcctaggtgacagagtgaaaccctgtctcaaaataataacaataatgataataaatcacattcttaatcatcttatcaaaactagtcattttttcatctagcatgtatgaagtaggatcttcctataatactaaatcacagctcagtgatcttttaaggaggtagtgatcataaagttaagatcttagactttggcatgaaatagaccaatgccttaagacctagctatgctgcttaccaactgtgtgaacttggataagttgcttattctctctacatttatgcttcatctgtaaaataagaaaagttctagcacctacctcagatgactgatgaaatcactaaataagataatgtacacaaagcactaagcacaatgcctagcacacagttggccctcaacaaatgtctactggtagcactagcagtataatagaaacaacagcaatagcagaagattgctccccaaactttatttcacctagctccatttttggaaaaacataaaaaccccactggtagtaatccaccatatatgtgtctctcctccctttcctggacagaagagaggactccacctcacactcccttcaattatgtcactttcagttcaaggaattaaagaaccaatgtgccatctccagtcactctcctcccctgctgtggcaacgtttgaagccatgcatcaggatgcagaaatcctggatcctgagtcactgcatggaaaagacccgtcccacagagtcacctgacctgcttcttactttaagcaaattagaaataaatctcaaatatgttaatccactgagatttgaagtttgttagttactgcagcaaaacttaccctatcctgaccaacaggtactcctatacttctaaaagggatcctaatatacttccaaaaagagaagacagtttttttaatagcttgttttttgtcaatctttatattttttactttgtaagacatcatattgcaagtaaattgacttttcaaaatctctgcgcttcttcctcattttacactttttaatctaaaagagaaaattgcattttacttgtattaaatatacagattaatactagagctttcactgagtcatatgtcacacagtcacatttcacctatgataccaaggtatcctgtgatcacagtaagaccagaacaaggaagggataatggaagtgccctcaagcattcacacactcctggcttatggcaacctgagacggttaagtggaattatggatatcacctattctaaactgaactaaccctcatgaaatggacaaatggttcgaaatgtttttaataaaagtggaaaaggttttatatgtcactaaaatgtatctcaatgtattattttgctctatctcatccacatttaattcttcgtggatgtcataaaagacacataatacactggcagtgtaatgcatcctgtaatttataaataaatatacatgtataattggggtctgtgctcaaagataaacttaatgaaagaagcatgagataagtcactttggagctaacagtttaaagaagagctttcaaactttttgtccctgcttgcaccattcctaaactgctttaaccattttccaaaaaattaaaatgaagagaaaaccagtataaaactggggggaaatgtgcattgtacaaacaggttcataaagacttcatgaaccagcaaaatcagaaagaagcagaaatgataccgaagagcatcattttagagtgaagaacaaacctttcggttccaactacaaaatcacatttctacgtctgaaaactagctttggctctgttagataatcaaaaggataaggtgattgttttctacacatagaatgaaaacaaaaggcagattttcctatagatcacaaatgcttctacaggcgcttaaactccaaaggagtggtagccagggaaacagttaggagggtcagcaggtgactccaagaaaggcagagcacttcgttagaccaacatcaaagccagttattggaaaatcacttgttcagtcaacttagagttatctcaatttccttcagaaagttaaataatatctgggaatttttgagccacgtggtatcacattccctatgccccagctcttagcacttctataagcaccaattagagatgaagctggggccaggtgtgcaatcctagaactttggaattactccttgaagccaggagttcaagaccggccttggcaaaatagcaagaccttgtctctacaaaaaaaaataattttaatcggcaggctgtggtgatatgtgcccgtagtcccagctactcagaaagctgaggtgtggaggatcatttgagccgggaagtcaaggctgcagtgagctatgatcaacgtcactacactccagcctgagcaacagcaagaccctgtctcttaaaaaaaaaaaaaaagagagagagagagagagagagcaagagatgaagctggaatttaaacccaggtatgtctgattccaaagcgcttataaaaatagcagcattttaggaaataaagtaggcattaaaaaagaaaagaaaagaaaatagcagcatataaaacaggcctcacagaataggtgggatttggaaatgaagactggctgagatttaaagggaggtggcaggaaaagcaggtgctgagaaggccaccagtggaagggagcagcaagagcaagggcatggcagtgcaaaaccttgggtgtgtgcaggaattaccaggcagtggtacagaaagcacagatgtggagggaggcagcacaagataaggctggaaatgttggcccaggccttctagtagaagtgctatgggctcagtcaagaaggtagactttattctggaggcaatgagtaatcactgagggctttaaagcaggaaaatagcataactgcaggtagacaccaggaacctgtttttcctgtggcatgaaggatggatcaaagaagagtatgaaggtgacttacatatagtagatagttaattaatgctgaatggatgaaggcaaaaacaccaagttaaaaatttattgtgtatctctaacataacaaacccatttgatccaattccatttcatattgttcaatctgctacttagagaacaacttcactcattctagtgggaaataatggtgctggtgcttcaaaataaaaatcaattcaccagtcaaatgtggcccactaaatgttgctcttaaagtctttattcttacagaaattaacattttcttcttctattcagaaggaggtacatctgaacagctgttgcaactgctgaaaaagaaaacaaaattaaccaagtacaaaagttaggcaatgacaagtgatcctccccaccccacccctctccccatctgcaaccatgtgaaaaggttatcggaaaataaggaaattacaagctgtaatggtatatttcctatgctctctcatagtgtctaagtcaaacacatactaagccataaccttcttgatgatgccaaactttcttctgcacaggtcgtggtaccatctgcaaagcatcaactactcagtgagaagccaaggctgaaaaatactgagatgagtcatgacctacctgattttcttcatgggaaaccctcatctgctccttgaggacagacatccgcgctgcctcttctttcctcaagactctctccttcttaagctcaggactccagaaagtcttaatactgttcatggaagatcccaatttgctgtccttgatgtctagctctttccggaggaggtcattctctctctgcagttctttcagctgggcctgaagatctaacattgtgctgtctcttacctgcctcaacatggaggggacctggtggtggtgatgatgggatgagccagtcagcccaccatgttgatctgtgtatgaaaggacatctgtgtgggaaagtccagcagaagcaatattgggactactccccatggctgtgacacggcctccatatacagctcgatttgtagcccttcccagagtcatagtgccctttgggtaggttgttgaagccaccccttcatgatcactcagatacatgggtccagacgtagcataggctgcattgagggactggatattctccatagacagagtcttgcctgttcctccacctcccccactacttgttcttcggtggcccaaacgaggagaccttggcaaacgaggggatctggaagggctaccttccagattggtgattgttcttgcacttccatacatttttcttgtattatgaggtgttactgaagagaagaaatgctatattaagttggggtttgagctaatatttccacgattgtccagaattttcaccgcattcttttcacagtccgtaccagaaaataactccactcagagatctacaaagtgaaaaaaagaataattaaaaacaaatttctttagaactctaactgcattgtatttttaaatatataaagataatgatagatgtacctatgtagataggtgattaataatagacagatagaaagagccacacccataatgttgatttataaagaaaagcaactctagaactttactactacaggtgaaagttttacaaattccccccaccctgcccctaagcaagataaaaattctcaaagtgaaaaataagctctattctttaagaaaatgaagctctctatattggtttgtgctaaggttagagttagaacctctagaaaattccccatggaattgcccatcatggagaccttagctataaaaaggcccctcctttggggcataacccctatatgcatgtgacttgaaagtgactctgagaagctgctgattcctgggatgtcaaatatttggcattcatgttgttaccttcccctcctgtactcattacagacatcactaatccatcacagtcttcttttccactaggttcagaattcttctcaacacaacactctagatggcttaccaccaatcaactggtattaacacatgaattcaaacctactggctatcctggagatagaagaaaaagaggtagctcaaccaatgggatgcctaaacacatagccagatcctcaatgatattaccagagaaaacaacagtcctgtctcttttccctttcacacacatctttcaggctggcctcttgagaattatttcccattttggttgaccttaatattcatattaaccacttcatgtctgtacagaaatggcaaaggagaagaagttcccatcacggttactgaagtatactagtgaagattttatgtagctggggctacagcattgtgagtatcccttcaattttagcacccatatggccttaatggggcacattatggcctcctgttcttcctcttagaaagtctttactgtattttcttttccttcagctttacaacaataaaagaacagatttgagaaaggcaaacaggttcaaatgtccatgctaatactaaccagctgagtaaccttagacaaattatttaacttgttatgagcttccactctgcaatcaacaaaatgcaggtagtaccatctaactcatagtattgtaagaaatagtaagatgaggtttataaaacacctagttttgtgcctagtaccaaatagtcaataaatagattttgaaggtaagtgtctcaatgagataagtacattaatagcagtatacatgggtatcttttattttcacctgcctatcattcatcccttccccctctcccaaatacacactttctgattatactgtcactattttccttagagaaattgttcccaaccccctactcacagttcactgggtttagataaggttgactcccttcactccaccatcctggatggtgcaaggggtgagaacatgacccacgcctggccaaccaccatattgtatcctccagacatggtagctagtttagtgatgggcatgtgacccacattggtccaacaagactccatactaggactctagttggaacagctgggaaagataagctcttcttcagctggaattccttactttcaagatagagctgtgagtacttcaatgtggaaagggcctccctgagggtggagacaatacaaagggaaccacagctaaacttcaaagagtgtgaaaccaaaccaggtgacatcacttcatactccagatccaggaatcatagaagttaccatcatctatcatctatacatctgttccctggccattttagttacatatgccaggtgactgattgcattaaaggtctcaatcctttactcctttttttatatatgtcttggcagtgttttcccaatgtgatgctaggttcagtcatgtgactttatttgtccagtaaggtgataacaaatgtgaagtaagcagacgccttaagcaacacatgtgtttactctcttgctcattttcctctaccatagtaattagaatattcccaatctagcctgatgcaagatgagaaatataaaatagaaccaagttgtcctagccaacaggcaagccgccccaagatgtgtgagcaagcccagccaaagtcagcagaactgcctagccaaccagccactgcccagcggggcatgagcgagcccagctgagatcagctaaacaccacacttatgcacttgataaatgcttcttagtatgtcactgatgttttgtggtggactgttttgccacattacaggatcaatgggtaactgatgcatttgtctataaatttcctttttgctacattcaattctagatgagatttctgtcacagatagtgacacatacagtatgaaaaaatgttttctataaaggtttcccctttccctcaagaggtcttaaaaaattatacacctgtttctaactaaagaacttcatttcaaatgtttatgttgctcagggcttaattttgtttttcttggaaatacacaaaaaccattttgtatctaagatttttacatgaataatctgtagtgtaaaaaagaggggatcaatagttctaacataagaattcggtgacataaatgataagagagacagataatggaatagtggaacaggcagttacatgaatatttaataagacagaaagatgttcatgacatactggtggcagggggagcagacgacaaaacaattttgtgatttactcacactgttgtaaaacacacaaatacacatacaccctttcaccagcaaagaaggctggaatgacacacatcaaagtgttaccagtggtggaattccaagaggttttcattttcttctttttatttgcatactctaaattttctacaattgaaactgactcaattgtcccatagagctgatgtcagtggtttctttgaaaaaacatagaaattgacctcccagttttaaaacttgagaaagttgcatttgtcttatctgagttcctttctaaggaaaccaaccatcaggcctcccagatagtgtcaaggagctcaaactcgccagattactgcatttgggcaatgagatgtcagacccttcatctgtcataattgccttgccctatctgcttccttttaaccaactcctcttccttatccctccctaattcctgtttttccactcatgattacatttcttccctgctatataaacccttacgttagttggtcaaggagatggatttgaaactgatctcccatctcctcagctgcagcacctgattaaaaccttcttctctggcaatacttgtctcagtgattggccttctgtgcagcaagcagcaggacctggactgaacctctggtgttttggtaacataataatgatatatacttttttcattaaaaaaatgattttctttctatggttccaacagttaaatgaatgtatcttttctgtgcttacaatctagatgtctgggttctaactgggccaccacttatagagatgtcttcctagaaaaagtgatgaaatctaacttgtcttcctctgtctgctccctttgtatctagagatacacatttctgaggtctgtggctaggcttgaggtcccggaatgtcataaaatttacacgcacacagatttaatcctcagtgaatttacctgcctacctggccaaggctttggagaatcccaataaccaacaaacaaagttagtttgttccctttggaaacacacacacatataacatacaacatgaaaagatgtattatcatgtttgaaatattgtttccttatttaaaaagtaatatatgttgccactggcccatagatttcttgggttctccttttctaggtttaataacagatgtatgctagtatcatagatagattgagaagctttccatttttcatatgttctggaacagttagcataataccagtcttccctattcctgaaatattttgtagaacacacacataaaactgaatgggcttggcagggaatgttgactcctgctgtaatgctagctactgaggaggctgaggcaggaggattgcttgaggacagaagttcaagaccagtctgggcaatatagcaagactctgtctctaaaaaaaatttttaaattagcccagtgtggtgtcatgtgcctgcagtcccagctacttggggagagtgaagcaggaggatcacttgagcccaggagttcgaggctacagtgagctataactgcaccactgcactccagcctgggtgacagagggagagacccagtctctttaaaaaagcaaaaaacacagaatgggcctagttgtttattatcttttcactttttcactatgtttacttgtctatttgggtttgctacctattttgtgtcaattatcattaaaacgtcccttcacaaacagtctattccgtgtagattttccagtcttattggcattgctttgtataacttttctttaaaattttttaaatgatatagcttttggttttattaatatattttactgcatcttattttccatttcattgatatctctttatctttaataaaatttctacttcctttatggtttttttttgcccttttgcattgaatgttcatttctctttaatcacatttcctaatgaatgcatataagattatacacatggctgcatattccagaattctatgtataaaactcttattggcatttgtaaataccttgctgtttttattttgaaatttttctatcccaggaattattgagaataatatatttaaatgtcaaagtggatagaaattttatggtaaactttctagttcaaattgtatagcattgggatcataaaatgtaacatatatattttccaatctttgaaatttgtcaagactttctaattggcttattagtttttcttaattattaaaccaactaatagattattatagaaaatttagaaaatacaaatatgcataaagcagaaaatgaaaacactctcaatcctgtcactcatagataacctctattaacaagctagcataataccagtcttccctattcctgaaatgtttcgtagaacacacacataaaactgaatgcggccgggcgaggtggctcacgcctgtaatcccagcactttgggaggccgaggcgggtggatcacgaggtcaggagatcgagaccatcctggctaacacggtgaaaccccatctctactaatagtaaagtacaaaaaattagccaggcgtggtggtgggcgcatgtagtcccagctactcgggaggctgaggcaggagaatggcatggacccaggaggcggagcttgcagtgagccaagatcacgccactgaactccagcctgggcaacagtgcaagactctgtctcaaaaaaaaaaaaaaaaaagaatgggcttggcagggcatgttgactcctgctgtaatcccagctactcaggaggctgaggcaggaggattgcttgaggacagcagttcaaaactagccagtatgtattatgttacttccaattccttttaagtgtgtatgtgtgtgtgtgcagttttagacaaagccagacaatataaagactatgtaaatcaaactatataaagactatatataagtcttgtattttcctttttctccatgttttatcttaacatcatctccatttcccacttaacatagatgccacaaagtatttttataacacaagatttttgacagatactatgagcctccaaagatggccatcaaaagtcctctccttcctatacagaattgtctgtagttccattagttccatcaagaaattgattctatttcctttgtccttgaatctggactggccttgtgacctgcttagaccaacaaatgcagtagaggagacactgttccagctctgagtctaaccctaaagaggcttgacagtttctggttttgctctcttaaaactcagctgccatgatgcaaagaagtccaagctatcttgctaaaattaggagccacacagaacggccctggaagatgaaataccacatacagagagaggccacgtgaaggagaaccaaagcacccagccaagagtcagcaccaaaacaccaatccagtgagacaagccatgttggagcttccagcccagcccagccaccgtctttaatcagctgcatgaataacagccatcactatatgtaacaagaccaccaatcaacccactgaatcaggtgggaagtaagaaattattatttaaagccccactccaagttttacagatttttgttacacagcaaaagaactgaaacacttaggtaattatttttaaaatggaaatatcataattaatattgtgattgataaagctttataatattttgattgataaagcttttcaatgttccgtttgagcaatattcagattgataaagctcttacttccctaggataaattctttttgttgttgttgagacagactgttgctctgtctcccagactggagtgcagtggcataatctcggctcactgcaacctccgcctcccgggttcaagtggctaattttggtatatttagtggagacagaatttcaccatgttggctaggctggtctcaaactcctaacctcaagtgatccacacgcctcggcctcccaaagttctgggattaccggcgtgagccaccatccccagccttccctgggataaattttaaaagaattataaaataaaaatgaaacagctggatacagtggcgtgtgcctgtagtcccactgcttgcgaggctaaggcagaaggaaagcttcagcccaggagttcaagtccagcctgggcaacaaagtgagaactcatctctataaaattaattaattagttaatttttaaaaaatcaaaatgaaacaatttatactcacatccttactcttgactctctttccttcacagcttctactctactctcaacatatcccaaaagccaccatctcctcttgaggctacaaaaaaaatcccgaattacgaaactcaggatttcagcactatacattcagtaaatacacctaaagaagtatttttttatttatttttaaggcagagtatcactattgtcacccaggctggagtgcagtggagcgaactcgcctcactgcaatctctgtctcccaggctcaagtgattctcgtgcctcagcctcctgagcagctggaccacaagcgcacaccccctcgcctggcaaatttttgtaatttttgaagaaacggggttttgtcatgttgcccaggcttgatcttcaactcctaagctcaagtgatccacccacctcagcctcccaaagtgctgggattacaggcgtgaaccaccgtgcccagccaagaagtatttattaagtaccaacattgtgctactccagctcggctttagaccagtacttcctgaacagtctgacaaatgttcagataaacaaggctactggggttttcgttttaacccaagatgtctcagagacttttaggacactcatatgtattgggactgtcccaaaattaagtatacaatatagcttttccaaaattgatttgacaaccgaatcctcttcccttcagaatacctgaaaacatttcactgaacacttgaatttactcatgcaataaatactttttaagcatcagcttaactcccactgttgaatgagggggataaggcagtgattgagacagacgcaggttctgactatgggaagtttgctccctggaatggactttctccataagagctttcttcacctcagatataacaggatttgagaggaaggtgattacaggactaggcactgctttaagggcaggtacatgaaatcaaccccaatcagaattgacctctaacaggaaaagatagaagatcaaaataatgactagttgaagtttcagccctactaggccaggaaataaatataattctgtatttatttttcacacctcgacaaagaagccagattgttaaaaggaatacaagtcagccattgacaggctgcagtaagaggctgtggaaacacgttgttgcttacaacaccaagatcacaatgggcaagagattatgttcaattccactgaacttatcaaatcaaacaggaaattcacagaccatcaaaatggtaaaagggtaatgtcttcaccactgtacatctgcttcttaacaataaattttagttagcgacgtaggctcaccactatttgggaattagtttctcccacaaaatttataaagagcaggggtggtttcctgggaccatttcacccccggctgcagcacatagagtgataccaatgtcatggaagaaggaaagaatcagttgacaacataaagcaaaggcaggtccccatggctgtcatgttcccctaagcctcataattcctacttgttctgttgagtcactcgcaccctcccccatgccccacccagctgtgtttcatttcccgatatattttaaggagcttgttttgacacttgggctttttttttttggttgttgtctcctaatttctcatctatcctgatttgtttctaattctataaaataaatctctgagaaagagcaaaaagatcaactttattgagcaatcaataatgcaatcatgtcttccattgcccattactgacttaaaactatttttaagcttttccacccacctataaatgggttttaggaaaaaaggtagcagttaagatcttacagttttaaatacttattatgaagccaagacaggttcagtcattggacttttttgtgaactctttaaaaatacctacaattttttttttttttttttggttgagatggagtctcactgtgtcgcccaggctggagagcagtggcctgatcttggctcactgcaagctccgcctcccgggttcacgccattctcctgactcagcctccccagtagctgggaccaaggcgcccaccaccacacctggctaattttttttttttttttttagttttagtagagacggggtttcaccgtgttagccaggatggtctcgatctcctgacctcgtgatctgctggccttggcttcccaaagtgctgggattacaggcgtgagccaccacgccccgccaatacctgccaatcttatatgtttgtgatgtgcaactgtaagaagggtaaattattaattaggtcaaactgtgtacagaaacaaataaatgttgctgacatcaaaaaaaattataacaccaaaaaaattagttgcgcaacacccttcactttaaaagaaactcatgaataaaattcaaagtccaagggtaagttccgcttatggctcaaacaaaataaaataaaagatggctttatgaacctataagaatgctttctctaattgcataggaattcataaataagatatacagtcatccactcactctcttaaaaggcttaaggactcttgaactataagctcagaagggaaaaagcaggggagaaccttgattcctgtctaactcaagtatctcagactatcatggtctggaacagtctattttaagacaaaagcacttcctgctatctgctctaaattaggttaagtttatttccacagatctccgcctcagcccatcacctgaggcctgctgacagaccgtgtgagctgagatcatcagtatctcccaagattttgccaacttaaaatatccttttttttctaatcagcatccctaacttttccaaaattctgtgtcacagactactaattctaaaaacctttctaaaggaagacacaatggaaaacagatctcaaacaagcagtggccacccaggagccagatgttacctgcagatgtgctgtgtatagctagcacagtgttgtttagaatttctattaatagttgccaacatagaaagatagacagttcatattaaaatccagattctgatgcttccttaaaaatctgaaaatctgacaatgtcaggctcacctttctacatggcaataactggttggagcaaccagcagctgccccttcaagagaggacatgtaccctccagtttgccacagtctcctccactcccattatcttatattcagtctgattcctttcctgcctgcttcccccaataggtatttacattttttaccactctactcacatataaggtcttaaacaattcattcttttacaattcattcttttaccacccacttcaagttctttaccaaatcttattaattctacctccaaaattgctcttgaatcttctccgttgtttccactcctcttgaaccaatgtgactcttgcataagctacttcatacctcctaaagcttctcctcttatcgtcctctactcttatttccaaaatatcagctaaactgttttaagatacaattacgattataaaatatctccccttacccacttaaaacccttttaaagcttcctattgctctgtggacaaaaccaaaacgcttcccatggcctgaggccctgcaggatctgagtacagccaacagcccccgcctcccctcttgccactctctccttcaaagactctgacagggtcttcttcctgctgctccaatgcatcaagtcccttcctgtctcagagccttcactcctgctgttctctttgcagggctaattcctattatttcctattccatcacttacatgatagtttcaatagcataccctctacaagatctatcccattcaaatcaggtctctcagttacattctctcaaagcgtaatgctttttttttttcatgatgtgaaagacatgctatcttttttctttttataagagaagctgactggccaagggtcatctcaatggccctcttgtttaggttaaagtagagttagactaggtagcctgaatcctctggtgaaggtgtaaggaaacccttcataacccaactgaggctgtccctcctcagatccctggtttggaaaatgtgaaatcttgtaggtgtctttatgcacaatgatccgggaacattcacggagggaagtcactgacaccccagtcttaggtgcccaggattcagagtaagtgagatctatgggaaggaattagcatagctccaccagacttagagttcccagaaattaaataattacttcaagatagaagtccaggctggtgattgggactcaggacatgtgacccagtagccatggagaagcccctattgacaaagtgtgtgggtaaggctagaagcttctggagacctcgcatgctgtatggagcctgtacagtggggcacaaaactgtgcacagggttgtaactcatgaggaaggctatatgtcctagttggggttccccaccggcagatgctgagacaaggatgtgggtgtaggaggttcatttataaggtattcccagaaagtactgagaggacaatttggaactaaaacaaggaagtcaaggaagtcaatagagggcgcattttcttctttttttttttttctttcttttttttttttttgagacggggtctccctctgactcccagactggagggcactggcacaatctcggctcactgcaccctccaactcccaggttcacgccattctcctgcctcagcctcccgagtagctgggattacaggcgcgcatcaccacacccggctaatttttgtattttggggtagggacagagtttcaccatgttagccaggctggtctcgaactcctgacctcaagtgatcctccggcctcagcctcccaaagtgctgggattacaggcgtgagccaccacacccggccgagagtgcattttcaagaaggtttctgctgcaagcaactggaaagagcttcgagaaacagtggagaaccggcctcataggtgcgcctccggaagggcaagaaactccatcatgggctgagggatgctccctggcactcccaagtgaagccaaagagaaagccctcatgttcccatacaggccatgagtgctgaggagatgcgggtggggcaccaatagcatccgctacacccccacatggcacactgtgtctgagcttggccacgggggactgggttggccttcccttgcaggaccacagagtggggaccacagagggcacgcacagcatctttcagtccgagggagaacagcctcaacagcgacaccttgtggcatcaagatgtaatcatgtgatgggctggtcggacagattgatttccagatttggatgtgggatttatatccatatcccgctcgctctggggctgtgtaagcccgaagcagcggggaggagaggaaagagagggagacgagaagtggggaaggttgggaaggcggtctagtggagagattcggaacttccagctaaactggcacatgggttccagcattttggatttaatttggacaaatgaaactgggagcaagggttgtttatttgcaatatattgtaatatactaatcttagtatatctgttacaatatttataaaatatagagattatattatttacatttaatatttaattttaatatattctcttttcatttatttttataaactttattaaagcagaacatatacatgatgaaggtagaccttaattgcacacgttaattgatttttttttttgagacagagtctcgctctgccacccaggctggagtgcagtggtgtgatctcggctcactgcaacctctgcctcctgagttcaagcgattctcctgcctcagcctctcgagtagctgcgattacaggtgcccaccaccaagcccagggaatttttgtatttttagtacagatggggctttgacattttgttcaggctggtctcgaactcctgacctcaagtgatccacccgcctcggcctcccaaagtgctaggattacaggtgtgagccactatgcccagcctgcaccggttaatttttatatagtgagcacacctgtgttaccactgtctagaccaagacttagaacattatcagcatccccaaagcctctctcatgtccagtaatccgtatatgacccaaaagcacttccataccttagaatttcatattaatatgtgcaattccttgttggggtctctcttccctcctattataaacccctacactgcaacccaggtttttacattggtgctaacactcttagagcccatggcaagagtacaaatggatgcccagataccatgtgcctatacatttaaagttataaactgagctaacaaactggtaaacaaaatacattctaccttcctaccttgaatacagagatggggaaggtgagatctgaattttgaacttagaatacttagactcctcagaattccaccaaaacattgtggccggaggaaggcctgccccccacacctccgccaacaccctttctccccacctctggcccaaccataccccacgggcctcatacacatgaactctgcagcatgcaagctaggcttgctccagctataccaggggtccacaggctttctctgtaaaaggccaaacagtacacattttaggttttgtgggccacttgatctctgtcataactactcaactctgccatttcagcccaaaagcagccgtagacaatttgaaaccaaataggcatggctgtgttccagtaaaattttatttataaaaacaagtggtagttggccgggcgcggtggctcacacctgtaattccagcactttgggaggccaaggcaggtggatcacaaggtcaggagatcgagaccatcctgattaacacggtgaaaccccatctctacaaaaaatacaaaacattagccaggcgtggtggcaggcgcctgtagtcccagctactcgggaggctgaggcaggagaatggcgtgaacccaggaggcagagcttgcagtcagccgagattgtgccactgcactccagcctgggcaacagagcgagactccatctcaaaaaaaaaaaaaaaaaagtggtagttggatttggcccacaggtagtagtttgctgacacctgatctgtaacgtcacacatatgtgcccctccacaaccctaagcctaggatgtgcacagtggtagcctggcttacccccaagaagatgtactaggaaaaaatttccaggcagattctggaagacaactcagggtcatttaggcaaggaggtcacaggcctgtaggtacccagagcggactctagaatgccaggcacaggctccaggtgggcacctgcattggtcccttggactcttcctccagtggacggtgcagtcagaggagaaccagagtaggccctctcgcccaagagtaagggaacacgggagctatgcaaaacaactttgaaataattgaaaggatgatgctggcactttaatatcatgacattttcatcatatcactaaaatcacttccatggcagttataggacaattctgtaattgtagccagagaggagagacatagtgttttaaaaaggaaaagaggagcctcaaaatcagatttggctggagtcatatttctgtcttctggatacgcaatcttgaacaaagtattttacttctctcatcctcacttttctcatctgtaaaatggggatatcagacttttcgtatagatttgggaaagattaaatgagatgatataagaaagtacttagcacaatacctagcacacagctaatgatcaacagaagttaaccttgacaagcccaaagctaccagaatataacacagtggctttcagcctcaaagttgccatagaattctcccagttcactaaacttagccctgtcagacactttggagtcaaactcaatctgctgttcaaaagtgctgaagacatcaaccccagttctctaaaactagagagaaaaatggacattgccttcccccatgatctgcaggctacaatattatgcatccatagttattcaaagtcccagtaataaaccatttcatctgtgaatgccatgatgtgaatcagtaaggggaaagtccagcttaatacagcagagattttcaaaattgctttcccatcattctccaaaaagctctatgaaactcaaacacgcctatccacacatcagtactctctcctttagttcccccaaactcattttataattactgttttccatgtgtagatttagcatgattacatgttcagctgccttggctcatgttttatggcaaggtacttgagtcaagaggctgactgtcttccatactacaaggcaagggctctgcatgcccaaatattagttaactgttctttccattaaccatttccattatttaaatttcagactccatcaatttatttcaaagtgttaaattaaggatctgaaacccctaaaaattttgttaaagtaataaactattatctagtacacagctaaatccacaagttaaaaatatagcaaaacagccaggtgtggtaagctcatgcctataatctcagcattttgggagaccaaggtgggaggatcacttcaggccaggagtttgagaccagcctgggcaacatgacgacaccccatctctacaaaaaattcaaaaataaattagtcaggtgtggtggtgtgcagttgtagtcctagctacttgggaggctgaggcaggagagtagcttgagtccaggagttcaaggcagcagggagctatgatcacgccgttgcgctccagcctgggtgacacagagagaccttatctctaaaaaaataaataaattttaaaaatggcaaaatcccaaacaataaacagtaaaattaagaaataatttgagatgttaaataaaattaaaataagtgacgtttaataaaatatgctgattataacaacattattcatcgccccataaagtctcataaatagaacaaattaagtagttgcactgaaagaataaataaggttttcagattcgttttttaaacatctatgcatttcctttcatctgcaaatgtaaaatgtcaattggcaaagcttcagttatagtatacttaaaaaaagaatattcaggaattattgggtcttacactaaaaaatcttctatctgtcaactaacagacgtttctgagaaaatgatagagagatagaataaaaactctgcccccttggccctaaaaatccaatcacacaaaattttgctacatttataatggcataaggattacgtgtaaatagctttttactagaaaagaatataggcataatcacatacgtgaggaaaaattttagcaaagattgtaagctattaaaaaaaaaagaccacaatcaatgagggatgaggaatggctccaatgggcaaattatggagacaagcattcatctatgtattctggaaagaagagaaagaataaacgttacatcctaaatctgaggtctctcaaaaatatgactgataaccatgaaagagtcacattggaggctttaacaaggatcaagttcagggtgctgaatggtatacagaaacccccttaacaatggaaattagagtaaatgagagtcagtaagtgcagtaagtaaatcaagtaattgagtcaaatctcttgtctatgaatggataatggtaggcttatctaacataaaaataaataaaaagggaaattacaggacataattcggatctattcaacaaatacttctggagaacaaatctgtaatgtggtttctgacatgatagaggtccaaagccttccatttaaaagggggtcacagcctctttactcaggttcacattaacaactctaattgttgtgcaaggctgccagttgctgtgaacaccagaaacagatgagggcctttctgggagtgatagagtgtggtctcagatggagagagtcctatggaaaaaagagtgtagtaacagacagggaaaatccagttttttaacctggacaagaactaaggagggaagtcagatccatagttatgcatattaaagaatctgcaaatctcatgagaatttaaggcttgtttttatttcagaaatctgaaaacaaataatgtaaggatattcttgatcagcacagcaccatgcccattgactttgaatatcaagctgtaccctaaggaatcactgagtcaatgtgaaaggaaataagatggtcttggggatctaaaggatgtgttctcactgggtgaaaggtaaggattgtcaagttcctcagaaagaatgaaagtttcacagaagttgactatgatgaatatggtgggaaaattgaatcatcacccagtgcacagcagggtagaccagatgatgccaaagaacctgtccagaatagtcagcatcacattctaattataagcagcaatttagttaatgcagttaaattaatgttatgaatttgaattagtaatgtcatatgacatatactctatttctaaattgatttaggttttaaaaaggtgtaagagctttaaaataaaactcaccagctttatgtttatacaatttaaagtatcattacataataataatttaagccaaccctggggttctacgagaaattattttcattaaaaaagatatcatctaagtctgagaaaccttggttaagtgattaagcatacactggatttgagacctgaatctcacatttattatctgtttaaccttgagcaagttagcaaacctctctgagcctcagtaagtatctgagtaacaatggcctcaagtgtaacaatggctacttcacaaaaataaggtgaataatgattaaatcagagaaggcagaagtacttagcacagtgcctgaggcttagtaaatactcagtacaatcctcatcatcatcaatattgaccacaggctcattgtgttgttttcttacattagaccctttcttcctcatgagtaaaatagaaataacagcgttaaacatcttgcaatgggtctaaaaaaagtagttgattaaaaaggttgccaaaaaaaaactttgcacatgcaagtaaaactttagcccatgcattaaattgcatcatgtgttcaacatattcaccatccccctagcctgcccatccctacagtctccttcctgtgggaagataatctttcctgctccaatgacatctggcttggccgtatgacttgttttggccaatgaaatgtgagcagaagtaacaaatgccataaccaaacagtagctatcagagccctcttgtgggtaaaacattcttttttcttctctaccatgaagataggctgtccaagaaaggctccttcagcctgtgtcccagaataaagataacatggagcagaatcacagacaacccctgagagaaagaagccactgagatttggaggtcctttgttagcccagcacaacctagcaatatctgactaataaacccagctaccacaaacacagtgctaaaaccaaatatgtaacatttagattaaaatataggacagtgctttctcactgatttatctctcatttctctcttcctctgcagattaccaaactaggaaatatcatccattccatgacagaatatcttctgttaggtctccagatagatgcaaatcatttgtaaataatttattttcagatacagatgcatacaaccaactattttaattgcctccaaatgtattctctttatcattcctgaccactgatttctttactgacaaatagctgctcctggtgcttggacatcgagatgaaggcaatcactggaaaagccgaaaggaggataaatcctgctaggaggtgacatagttgtacaaacaatccaaatagtgaatgccagcgagcatcaatgggcgtgggctggacctcgtatgatcagtacacatgtgagtgcctgtcctggagcacagccctaggaagaatccagctgtaactgacccaagcatgcctccacaccaaaagaaaggcaacacatgcacccacctcctgctatcgtgattccatcttataatggctgtgtgacttacagattgcaccaactgatgaccctgtcttcacttgaaccttttgcaaaacagatgattcaaccctgtaccttccttaaaggcaagaactatgtcttcttcatcttcatatctcagcactagtttacacttgcaattaaaaggcaactcaatgtagagcagtttaaagcatgggctctgaagagtccaaattccagtttctccacttacttaggttaagatcttgcaagcagatgctctaagtgcctatcgatgtccctctgacctgaacattttagagtgccccaaaggcactgccaatatcagaatctctgcctgagagtatcttttaaacctggataagctagtcttcccttgcagggtgtagaagtcccagggttaaccacccttaaaaaaaaatctgacagctatttatacaacagtgttcacaaccgcattattcatgatagccaaaaggtgaaaacaaccgaaatgtccactgatgttgaatgcataaagaaaatgaagtatacacataaaatggaatattattcatccttaaaaaagaaatgaggaggccaaggtgggtggattatatgaggccaggagttcaagaccagcatggccaacatggcaaaaccccatctttactaaaaaatacaaaaattagccgggcatgttggcatgcacctgtagtcctagctacttgggaggctgaggcacgaggatcacgtgaacccgggaggcagaggttgagaggttgcagcgagccaagactctgtcactgcactcccacttgggcaacagagtgagactctgtctcagaaaaaaaaaaaaaaaaaaaggaaatgaaattctgatacgtgctacaacatgaactttgaaaacattatgctaagtgaaataaaccagccacaaaagctcaaatattgtctgatatcatttatatgaggtacctagaatagtcaaattcatagagacagaaagtataatggtggtttccaggggctgggggaatgtggagttattgtttaattagtacctagtttcagtatgggatgatgagaaagctctggagattgatggtggtgatggctgtacaacattgcaaatatacttagtacaccaaactgtgcactttaaaatggttacaatggtaaattttatgttatgtatattttaccacagtaaaaaaataaaaataattaaaataaatttaaaaaaaagaaaagaaaaaaaaacaactgacatgaactagtggtgagacatccctactctcctagcctttgtgtaaaaataccctaaggcaggtgttttacactatctctacaatttccttatgggattaaacactagttgccattgcacaactcgcttaacaatgcaccatctattggctgccttcacttccctgtctcatatcctcattcactcactagtgaccccctgtaagtcccaagtaactatttgtctcagggtctgcttctgtgggaaagtcaactaagacaccaaggcaagtttcttaatttctctaaacattactttccttatcaataaaaataatacttagatcatgaagttattgtgaagattaaacgagataattcttcaaagtacttagcacagtgcctgactcatagtagatacttaatatgatcttcttgaatttctggtctaacaattatccaccttttttatagaagataaactacgtctctcagtttcaggaagagactaaaaaaatctaagagccaattctttcccatcttctatttaaataacatctctcatgacttagcactcatcattcaaccaaccacaagaggtattagaaagaactggaattttgtatccagctcaatcttttgcctagaggtgggctgagcccacaaaaaaagttagataagctccccagatagcaagaagacccccccaggacagacagataaccaccactccctcctgacctagggaattagagggctgtggggtcaattgtaaacaactttgatctggtaaattttatgcgtatccctttctctctttggttacaaatgtaccctcctaaggtttatggcaaagactagaattcatttagtctttttctagttccacagtgcatcattttaacaaatgaaaccatgggatcatgaaattcccagtgaggtgaatcctttgccaaatgccattttattttgctttgatttctcgttacttgtttgccaaaatacacagagattttatcacaataatcacctattctgactagcaaaccaaaggattaggttacatactctggtggactcataaataagactgatgagaaatccaatttctgtctcttgcttttgtagaaaacacctttctgaatatgtactttttaaaaagctgaacaaacaaaacttaccttgacttacatgttaaaaagggaagctctgttccccaaaacaaataaatgataaaatcccaaattccatcttgctctttaatataatccctaaagcttttttccaacatttcatacatacatagcctttaacttcactcacaactataaatagttggccaatttaagttcaaagcatctgactaaagctaaccactagccatattgggcatgcctaatggtttcaatgtttggctcaattacattatgagctaaatagttctccctgtattattgcctacagttttccattttccacttataaattaatgacaaaattcaagaaatattcaggtgattgcacaaactgttgtacaaatatggtgatgctgatgaactaaaactacttgtcggcaggtaaggtcatggtacagtagctcagaatggtggttcataagctacagcacagaagattaatgtatgaaaggcaatttaacagtgctactgtataatgtacaaaagtgtaaatcatatcgaagtaaagtaagaggcagacactatgcacgggatattgaatagtgttctagcccataactcccaatcttgtacatttcaaggaataatgaaactatttccattcatgaactttctcagacccctttcagaagctgtacactatgaattacttcaagtatttccctcgattaatctaacaaagtcagtttcattctgcccattaagtacaaagattttgaaacacaatgtgtactctctgtgctctgcttaaaatttattgaaatgaactttgtcctaggtgatattgggagagagtctcaaaaccaacaagtgatgtggagtcccactgcagatctttcaccagcagatatttttcctcacctggaaaatggtctttcaaaattattaaggctgtataaattgtgtttggtcaatgaatcagaatggacattgctaggagtcccaaagccataataatcaatctttctattgttcttcaggtcatcttgccaccctctcttcccaatgtcaagtcccacactcccacaagcatcaaaagtaggtaattattgccatgacggtgaaataaaaggagaataaagagaattcagagtccttgatcgtatccgtcccctacttgaaatctcttgaagttttaagcttgagtcccatctcctcaatggctcacagggtcttatgccctgtcacactctctggctcctctcaccatccctcatcctgagccaagctaaactccagctctacagttctacctacatttacctccgtgaaccctgaatctcccattctctcgcttacctttggacctagtgcatgctattccccctgttatttgtaccttcaaatcctccctcctctggctaattccatttacccttcagtgacactttaggtgctactttcttcaggaagccttccttcattcttcatccatgactctcctaagtcttccatgatagcctggatgttcccccaaagagcatccattattgcctgcttacttgtttggtgctccactggatactacaatccctgaactcccctacaaaattacctgctctattatggtcctcttgacgtgtacacaccctattcccagaagaagactggcacaaagcaagcatacacttttacgacgactacataacagaatggcttaattctttgttactaatgtctattatgaaagaacaccagccactcctgttttccaggttaaaataactaataaaatgataattacttagttgaacctttgcatgaagaaactgttgtaaaaatatatatataatagatctagaagagtgcctttgaagcaaattggactagatgatagagaaacagagatcccaaataaggagaaagctagtggcaaagccagaaagggaacttagggcttgtgaccccaggtcagtgctatgtctctgtatccaaaagaatctgctctgaagttattctaagcaactattcatgttgtgaattcaaggtggcccatgaatgcattcaaagcccatgtataaaaagagagttatttctcagctttaacaaaaaaggtgaagaattccccttgcgtgcccacactaactgctccacgctcacaagcctgatgaacagcagccactaagacccaggtgcttttgtatccacccagcatcaaacaggacctattttcaacaagcccatacgaatgccacgctgttatcccactcactacccaacctcctgcttcctgtcagggagaggcttcatgaacaatacgaataaagggtcaaaatgcgaaacaaagaagggggaggagggaatgttacagccttagaagggaaggaaaaacatacatcaccagaaggaaagaaaagacatcaaaaatcctctcctgagatgtcaatgtaaaaaaagagtcaacaaccctgctcctctcggaacccgccccttgaaccacgactgctcctcgaggtgatgacagctggagctggctgacaaaacggagcatggctaatctgcctcaagccaggcacaagaaagacatcttggtagaaatttgatgcccaccagtatcactgagaaaataaccagtgatcatgggaccgccctaacctcacatctggcagagctgctcaactctcactgccagagcagctcccagaccccaaacccaccttcaatcacctcaggcccatagaggatgaactcctgaccacacctatcttattatagagaaatatgccacataagaactggtaaccacagtgcacaactaggttcaatttcttataggaaaccctgctctttcttactgcaattagtcataccatttagcagaaatctttcacggtttgcataaggatctgagcatattcttaaagaacagtcacattgctcaattcccattcaagctcttgtcttctgacccactaagaagttgccttgaattaatagtttgctcctaatgcatttagggtaaatgcactttgctgcctgcaactcattcatgccctgaaatcacagaatgacaactacctttaggggtggaaagtattaagacaggaaaagagagctaatgctatcagaccacacacacacacacacacacacacacactcacacaggataattaagtgagcaaaatgtagactctgaaaaataaaccatagcaaaactaagttgctggtataagatgtctatgaacattgcggctggcctttggttttcaggtatatctcacagatgcccttccaactcttcatccagtggggctataatctcaccattgacttccaggaaaaaataaccacttagttccttcctgaaggttcttcctgcctttatttattttcttctcttcttccatgcacacgcactctctctctttttaattttgttgagtgctgattaggtgccagcaactagagattcctgggctctgaccaagcgaactctgcttggcagagtcaacatgagttcaagaacagaggaaatgcaacttcaaagcaacaaatctggaagatgtaagtggagaagtaatgcccaagaggttaagagcagaactttgaggcacgccctgggaattggccagccaagtgctgaagaaattaggctggagtagcagatgaactggcccaagagaagggtaaccaattatattaacaattaagtcagtgatgtagtggccttggacttccccagctgaaagaatgagcagaaaatcacaaagaaggctcggccctggctgtgaaagtgagacagcttagagctcctggtgcttttggcattgacaatggttaaggcttgttggttgtttctgttgtaattgtggggccactcattgtttctactttctctagtgataatttagcagccttgagagtaaggcagaggtggattcaaactctggctctgccacagcattaactctgagcaagtttttctgttccttcagtcatttgacaaatacttacagaacatctaggcactagggatacagccaaaggcaaagctcctgcctttatggaacttatcaaattatttgagtctcagtttcctcacctataaaatgggataatacatttacctgtataggtaatatgaaatgagcaatataaagcacctagcacagtgcctaccacatagtaaatgctcaataaatggtgctcttcatataacagagcaaacgtatccatcacttccaactggagtattagctccaagtagtaaggaactatctgttgttcatctctgtacccccagtgcctaacacaaagtagatactcaataaatacttcacaaatcaatcactacttaataacagccattgttatggtaacttatagtcattattcctctctaagccacagagattctatacttgaaaaagcaacatggcggcctagcgtggtggctcacgcctgtaatcctagcactttgggaggccgaggcgggcggatcacggggtcacgagatcaagaccatcctggctaacacggtgaaaccccgtctctactaaaaatacaaaaaaaaaaaaaaaaagcaagatggcataaaggctttttttttttttttaaagaacagtgaggtgcactatacaatatgtcttcaggaactttttaagcatgaaaacaaatgttattgagcataaagctttcaattcaaagaatctattagcacagagaccagcacggacagcggatgtagatgccagcccactcttttcctaactacaaagtaaggacaagctggccaggcttcaggttaatccagaaggcacccaaaaagtaagttacataaagtttagcagatgtgctcaaagatggtgtatcagtaaagataagcagaaaagtgctgcagaaaccaaaaatcacaaaactcttcatggcttaaaacaaccaaagtttacttcttggtctatatgtccaactccagttgacgggaagctgtgttcatttagtgactgaaaggcccaggcagatgaagggctccatctcaacacacatttccgtaatcattgcagtagaagagggcactgggtgctctcacactggaaatcaaatattctagcatggaagtgatgcaagccacctccaacatatgcctggaaggaaagaaaaagtggctatggggaacattaacagtctctaccacagatgatattaagacacaacctgtggaataacaaagggatttgttaaagatgatgcacaaataaaacatctgaacagctataagattcacataatcatgaaccaggaagggtgtgtaggtgtcattttagagcagtggcctcaacataaagacacttcatacaacataaatctggaccctaaatttccagaacagctctgctttctataaatatactgagggtccagataaatttttatttaggaaacaaagttttaacagctgaaaaacatttgaaaactatgaatgtaaaccaaatcctttattttacaaatttaaaaagtaaagagaagaaaaaaaggagacacagacagttaaagtaaccccaatctacccctcaaggaaggtctagaatgtttagcagaaataagtccatggacagaatctaatgtaccactgcagcaccttctgaccttacccttcatctctgctacctttaactggcacagtggagccagacccagaccaaagtcatttaatacaaggtcgtcaagggctcaataaatggtattgacaatgagtagaagaccccaccccacagcatgaaatagtgattcatatctcattagcaattctctacattactcattccctacttctgggcaaatgtgaagccatcagtagaagtgaatactagccttcaggagactttcattttgctctcagatgatcataggttaacagcaactatgatttgggttcactcaattccattatcttctcatgtccccagctctgtttcatgcccagttttccctccaccttcactcgtactaaagcatgtatgtcatgcactcaagcctcagtggtctcccaacctctggtctctgtctttttcaatggctttatactcactagcccatgaaatcaaactcaaatatttcaaccaggaatccagatgcctcctaaatcttaatccagcctaattttccaacattatctccactatggtacttgtcctgcacagccagaggcaagatgatgatcctgaaagtcaaaatgatgttgttttgaacccccaatgcttctacttactggttgggcaagtccttaacccctctaagttttaatgttctcacctgcaaaataggtgatagcacctactttgagggttttcttgagaaggtatgtatcagtgaggagtatgtgcggctgcaagtaataagtagtggcttacaagtaaagagctttttagttttatgcaataagaactacaggggaaggcagtctaagctggtactatgaatgaacgatgtcaccaagaccaagatccttccaggctccagctttgccatttgtaagacacgattttggctgggcatggtggctcacacctctaatcccagcactttgggaggccaaggcaggcagatcacttgagctcgggagttcaagaccagcctgggcaacatggggaaatctcatctttacaaaagtatacaaaaatcagccaggcatggtagtgcgcacctgtagttccagctactgggaagactgaggtgggagaatcacttgagccggggaagtcaaggctgcagtgagctgagatcggtgccactgcactccagcctgggtgacagagtgaggccctgtctcaaaagcaaacaaaaaaaaacaaaaaccatggctttatcttcattgttgtagttggctgctgcccctccaggcattgcaccaatgatctcagcagcaagaagttaaagagctgaaaagttcttggagtataccacccacgtgtgtctcactcactacattttcaggaaagcctccacccaaaaacttccacctatgccattatcagacccaactctcatggccactctaagtccaagggagtcttgggaaggtgaggtgggcttatttccatctcagacaaaattggggttcttttagttggaaaggagaaaatgaatgttgggtaggcaaccagcaagcctacccaatattaaatatcttatggaaagtgctaagcacagtgcctaacacatagttaactgcccaatagaagttaagctataaatactagtgttataattattattgttgttgtaattcacctttcttactctctggccaagtggaataactcattatatccatgtgtgcccctacatttttatggtatccattgctctatctgcatctccaactctctccctgctttaaggtccaggaaaatgccattgcatccaagaagtccttccttacacctattcctaatgataagtttcatggtggcaggacccacatcagaataaaactgtgttcaccactgcactgaacattgtctcttggaacacagtaggttctaataaatagtgccttaataatttaagtaattcatgtgtatacacaaacctgttttatagccagccctctaaaatcaaacagagaatattcctgaaatgcagaagttaaggaccaggtttatatgtcacgcagctagcaatgggagtgaggggatgaaaattgcattccccaagaaaaagaaaaaattagaaaatcctctaaccataatttttacatgctgttggaagctggatgatagttcatcaaatattcgctcccttactgtgaacagagtctacgtttacagacaagtgttgtccaaaatagtacttttccaaaacaggttattagtgaaagtgacatttgctcgtgtagtttgcctcttggctccagtgatctgccaggagaaaagcatgccccaggtagctgccatcccttcagcctgggccccaggacacatgtggaggagactggaacccaacccacagcctctacacagccaccccaaggagcccaacctataccagccaaatcacggtcaacctgaagacccatgagtgtgaaaataaatacctgttgctgtaagtcagggagttttgttacactgccaaagctgactaatatatcttatcatttgatatatgttagcatgtcttatatcttcattcattttgttccttttcttcacataagaagaagaggttgtagagtctccatgttttgtacatccagtgagttctacctttggatcaactattttaaatttatgagatctacattaccatgaatattggtgcttttctgtgctttccattcatcctatctttctaaactaagaaaatcacaataaaatataaaggaatagtgtaaacattgctgaaactgaaactgttggctggcaagtagatgccccacggaccagccaaaatgttaactggttagaggattttaaaaaaagaaaaaagaaaaaaaaaaaggctagagggtgtcctagtaaaacaagcaaatgcagattgtacaaaagtcaacctaaccaaagtcaaagactctttaggtaaatttgtggactgcaataccattcaccttatttttcaggatacctgttttggcaaaccttcaccactgagtttcaccaatgggaagagactgataaggcttacatcttgtagcttttccaacataacaaaacaagaggggccggtcatggtggttcacacctgtaatgccagcactttgggaggccaaggcaggaggatcacctgaggtcaggagttcaagaccagcctggccaacatggtgaaacccagtctgtactaaaaatacaaaaattagagaggcatggtggcgggcacctgtaatcccagctacttgggaggctgaggcaggagaatcacttgaacccgggaggcagagattgcagtgagccaagatcacgccactgcactccagcctggtgacagagcaagactccatttcaaaaaacaataaaaaataaaataaaacaagacggtcatgctattacaaaagaataattttaaatatcattatacctaatcactaatggaaaagggtctctgtaaataacaaagaaaataaaaccctaatcccttggtggggagacaactgaaggatgttaagagcatttattcaaccaagatctatttaaaactctaattggaaatttaaggtgtcaagaaaaatggaagagtgtgaattttgttttgttttaccttcttttaagtcatcatcattaagtttggaaccaaatttttatcgagccaaaatttttattttattatgtgttatattttttatattttattatgtttctactggaaatatataataaacagagttactaaatttgcctattggcccatgccacagccttcaaatgcaaaggcaaaacaggctgataaaaggactgtcagaatcacagtggactcttaaaatggttagctctacgtatgctgggagaacccacacttcagactggacacatgcagactacacaaccaaaatttgaagtcaaggccacggccaaggtcatgggctctgggtaagacgaacccgggctcaggttcttgctttcatactaaactgtggcaagatactgaattccttctagttactcatctataatttgggcgtaagaatagtacctacctcacaggggctccacaaggtttaaaaaagataatgcatataaagtactcaacaaagtgcttgcctatgcaataacaatgatgatgatagtaatagtaataatactgctttgacaaacccggcttctacatgaaaaccattctaatcagtatattctggctcacagtctgtttatgaaaggcttaattcacagaattatgttcacatccaggtacaacttctataaagtgacagctctttggatcaatcagtaatttttctaatgaattcagggagaagggtgttgaaaaatcaggctttcactagtagtgagttgagatggatctggtccttcacccatgattcatccacccgtgaaagtcttgctggtgaaaaccatgacaccatcaccttccacacccctccctgccaaaactgtaaaagtattttattaaagcacagaagcaaacagacaagatggcttacatgagaaaaaggcaaactctactactccccggaaagaaaatggcttgaccccaccaccaccgaactgacattctgcaaaagagaacaaggcagccctcacttccagaagttgagttaactgtcagaactaaaagaatcccttctattcatgtgactccccataaagaacgtttgccggctccaaaaataccttataaatccatccagtagagccaagccccaagtactgtatactgagaaacaatgtgactttacaaggacaagagtgaccataggagacaaagtgccacacccttttcccggatagctcaacggtacatgttgtctcttataaagactgcaattctggagaaataggtgggcaattctaacaccccctcccccaattccttctttacacagattcattttcatttttaagccagtggcctcggcatccgcaactactacaactaataatcaggggggtggtgggtaagggatggggaggacaaggaaacacaggtcaaatatacttgcttctaaaagtccattttcaaagagttttcttcccgcttgtctgcctctcacagctgtatccccataccaggtggaaaccaatggttaagtaaaatcactgatttaaagagccaaccaggaaactaaccatgacaagtgggagctgccctcctctcccgagcattgattggttctttgggttccaccggtccccattctacccacgtaagtggcaggtgtggctgtcaatcacagagggaaccgacaattcaccgctcggggagtaaattgcctttcatacagcaaaggcaggtagccgcctaaaatcgatccactcctaaaagagcggaccctccctctctggcaaggagaacagagacccttaagtacaaaataaataaggcagggccgaacggagagtttacgagcgctattttattaccccgaaccaaagcagctcttaatcttcactgtcctaagacgatctttcaaaggctcgtacggtattttttttaattaggtacaccttcgtaagtatccctttttttgtataattaggagatggggaggaggagagaagggatgccgttcagttcaatttcacatcgtattccttttcatacaccatcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagcaggagcgggaggcggaggaagaggaggagaagcggggcggggaacagggagggaggaaagaagggaaggaggaggacactgctcggagggccagggccaggcgcggggccgggcggggccggcggccgagggggcggcacccgccgcagtcccgagacgcgcgctcgcgcggcgctgccaggcgctgcgctcggcggggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccgcggcgcgaagcacctgtccccaatcttccatccccgacgccccttcccgggtacccccctccaaaagctgccaggcacactgggaacttgtcaggtggctttggtgacaggggcagggatggcacttatcttttaagttaagcattggagtaaggggtcgtggttaccataccctggcaccgtccatcagctttaatgttccttaggaggttgaaagaatttcataagatcttcactttattgttcccccaaagaaaggacagaatgaaagataaagacaggaacaagagaaaagatcgcatccgtcatattcactgggtgcctcttctgtgccctgaaatgtgcttgcattgtcccaatttaaggtagaaagatgatgtctgagttgatacgcgcgcacacaggcagatacacacacacacctcaaggtaatgagcaagaggatttggacaagtttttcattggaaaaagcttccactcaacaagtctggagccccagctgctgccattttatattagggagggtactgggatagccatgggcatctttaaacttggtctctttcactgagtagtcaatttgcagggatagagcagtcatttccttcctgtcctgatgagtctgcttccagcaatttcagtggccagatctaaatttctcctgctgggaagctcagacaaataaagcaaatccagccatgggatgtttgggtgcgcagaggcatagaattagtacagcgattagaggatggatccttctttcctccccgataggaattcaatttttttttttttttttttggagacagagtcttgctctttctcccaggctggagtgcagtggtgccatctcagctcactgcaacctctgcctcctgggttcaagcaattccctgcttcagccacctgagcagctgggattacaggagtccatcaccacgcccagctaatttttgtatttttagtacagacgggatttcaccatcttggccaggctggtcttgaactcctgacctcaaatgatccgctgacctcaagcttctcaaagtgctggcgttacaggcgtgagccaccgcgccccgccggaattcaaatattaaatgattcctgctcagggaatcagactctgagagacaaggatgccttcctgttccagcccaaatgcctgttccttaagcctgtacacctctggtagctaaggtttttcatagactctctttgccctcatcctcttctttctctctctgagaaatcaacactcattctcctgacctagatgctccaggggcaaaaccaagctccacctattgtgttttgttccccacatacatccttgacagcctctgctcaaaaggcttgttgtatatgagagccttgttgagagtcctttgagaattcctaaaatcccacatcttttgaaacgtggccaacattttttagtacccccctctgtgcaggcacttacattttctcaactattctcacaaatattctataagatgtttaccaactttcagaaaagttgggtaacataccagggtgatcccatgaagaatttatttaaatcaatgcctgaggttcactctggttggccacccattctcttttcctttgatccgtgggttttaaaaggaacccttgacattcaggggatcaatttattatgtacatgcttatgtacatttttcccacagagagaagattcatggttctcaacagatttctttcaaattgggtccttgacccagaaaagttaagaataattactttaaatagaaagtgactctacatagtaaaacgaagagtggaagttataggaatcttaagcaagtcatctttatcctctctgggacttagttttctgaaaataaaaagcggaactaaagaatcttaagattgctctcaactctaacattttctaactttaggttaaaatacacatatatgtgtgtataggtacacaaatacatacacaaacacacacacacacaaacaaacacaccctcgcaatatgctaacaagtagccattgtgagatctaacccttcaggacagaaaattctaaaacatattatattttctaaaacatggtctgttgctccagggttttttgttgtcgtggtggtttggtttggtttgtattgttttgacagttattgatgtctttcttcatcttcacaagctcttttcaagcaagtcagagagagcatactttcatggcagatatttttttctcacatattcattcattcattcaacaaatacttattgagcatctactttctcctaggtcctgtgggttcagagcccctgcctcaaggactgtacagtttagtgatggagacagacaagaagcaggcaataacaatactgcctatgaagggacaaagttctgggaactgcaggaacatgcaggaaggataaccaactgttcccctggggttcagaaaaagttttcctgaggaaatgtcaaatttgctgccacatccaactttgctgccctatggtgtgctcagcctggagtggcagctatcatagatgggagctgtggtggacacctgcccctggatgagccatgacaggctctccttccagtatttcaaactgagcttgaagaatgagtcagtcagctggcattgaatggtgagattgtagactgtggtggcccaaattagaacaatggcaccaaaaaccatgatgccaaagtcatcaggaagtaagttctaagatccttgccaaggaagttggtctgtaaagaggagaacagccagccatgtagacagaaatgagatttctaaagacctaaaggccttggatatctacctgcttatttgacttccccagtgtgagtatttaacccaccagtatctcaaacttgatttttatgcaccaagtctcctctctcccaaggtcacccatcaggataatgacatcaccaatcatcctgttgctcaggtccaaacctaggagtatcattaattcttccttttgcttataccacacgtttacaccatcagccagttctatcagctttacttggggctgagccaagccatatcaaaccctgaagcaaaagaaaaactctgtacccgtacatattttttgaaccaaatagaaaaagttaagctctacagtgaaaaagcatgactatatataaaagcaccgtaatgcccaatcagttttcctatgattgtcaaccctcacaagcctgccagtgtgggaatatgagagccaagtggccttggaactgagcacaggttggaaacaactgttcttcttgcacaatgatgcagggtcataaaacaacaacctgtgttggttttgtttttgtttctttgggttttttgcattcattttgaatatagtaacagcaacaaagaacaaataccaattagacaaaatcagtactatgtgcgaggccctgttctaagctctttgtgtgcattaactgacttattcctcgcaattgacctaaaatataccattattacacctattttaccaacaaaggcactgaggcacctctaggtaaggtaatttaccagggccacacagctaagtcatcgcagggctgaaattctaacccaagaagtctgactccagaacaaacgaggtaaaataaactggacttggtgagcaattggctatgtgcaagagagaggagtcaaaaatgttcccaggagtctggtttgggcagctaggtggatagtgtgccattcactaaaactggaaataaaggttggggaggagtacaggtttatggaaagtttatagatcatatgggaaacccaattatgaacagtttatgggttcaatttaaggcttttcgtatttgagatgccaaggacctcatggtagagatgtccagaacatggcagtttcaatgtgctttgaagtcagacagcagatacttgatgaagacagtatatgagagtcaccaagtttggtgattagagtcctgggcatagccgagtaacccagaacagtcattagcatgtccacaggaagaatctagttgaataagaaacaaaatccctaaacaacttataattgtctgttcttcttaggcatgaggtcatttgcgcaagtcttaacagggtagattttagctcaaaagaaacatgattgagctgccactttaaaacaaaacaaaacacctaattaactgacccatcaccacaacagttggactggaaaaaagtcacctgatcctttggaagccaacaattggtgccgttaaaccattcaaattatatttgccagaaatgttttaagacctttgtaggttttaagcatcatagcaaagatatcaaaatccagcaccatcaaaagtatatatttttttggctgtgcatggtagctcacatctgtaatccagcactttgggaggccaaggcaggaggatcacttgagcccaggaggtcaaggctgcagtaagctgtgatcacaccactgcactccagcacaggtgacagaataagactctgtcaaaaatatatatatatttatacacacacacacatgcacacacacacatttgtttttctgtgaaaatgcttgaaagttttttaaattatttgagcaagaaccattcattttacttacttgtggctgtggttgtccaaaatcattaagcatactcagagactattataaggtgagaagaaaatctaacatacagttgtttgcaaatgaaaggaaatgtttataaatatgaaaacccataaagttatattttgtagacatttattaaacatttaattctcaatttataattttctgtaaatctgtcatctcaaggcaggcaagtctttcagggctttgcaaaaatgttgattaaatgttcatataatgtaaaataacatcaatttctttagttccttggcttccaataacctcatttcctgactttaatcactcatgaagtctgaccccccccttgctatccttgggttccatgacaggcctctatgttttttcagtagataccttcttttttgtttgtttgtttttgcctccttaagtatctttagtgagtttctcttccttgcaaccacaagtactgtcggaattgaaagtcagcttccttccacctaggcaagccccccactctgggctctgtgtgtttctctgtggtattttccatgaactgctgcccattgcttgggcctcctcttccttcctcattccctggcttggctatttaaaggtagttcattagcaccttttaaattatgataaaagctgtaaaattaggagaatttttaacatacccattttaaaataactccaaggtagaaaagacctgtttgaagctctcgaggagagaaataaccacagacacaggctttaaaacctccaccatgcagcagactcacgtaatcttatttgtctcactcaaaccctgcttcctttagtcttgtgctttttgctaccaaaggatttatattcagacaccacgcagttttccttctaaagctaaaggcttacgagagagttgagctagcctagaaacctatgaagagttcttaccttgaatcttgtctgcatttccatccatgcagatactgaaaagacccaggcaaaaaattaaagcaagctagtaataggattcactacaatcagaaaaaaataacaaaattcaggggaggtattgaaatatgaaaggtgtataaaatatcaattacacagcaaagcccacctttttacagttttcctccacagtggcaaaagttcagaatttaatagttgtgtgtcttcagacaaattacttacttagagattcttttccttatttataaaataggactagtcacagtttcttttcaacatgactgtgatgaggataatcatataactattcaggtaaagtccttagatcactcaagaaatggtggcttctgtgctcataataatgatcatgaaaagagtgtaatttacatacaacattcttagaaggtttaaattaatctgtgaaactttataataaatggccaggactagggtgaagcaagtgaaaccctagccttgggtgcacaattcaaaagggtaccaaattctcagtaatcaagatgcattatattttaatataatatttttgaaaaacaaattcgtaaactacagcccatggaccagctacttgtttctgtaaataaagttttattggaagttttgagaaacaataaagagaaaaaaggaccggagcttcctttataggaattttacaccctgagggtccaaagaagaatttcttatactagggcttttaattaacagccaaattcctagtgctaggagtgctgctgaacacttgcattcatctattatctttacagcctagactctctgtgggcaggagaaaaacacctgttcaaaaggtgggttctcattgtgagaggaagggtaacaagctattcagcaattcttggaaccaaaatgaacttgtttacccattttaacaagaacccaaggtctacagaatacctgcttttgactatatattggaaaaatcaatgagataaatatctgaataaacacactgaatactcgataaatatgagtcattttttagtaatatgagaattgttaatgtaatttgaagagtggaatccacagttgtactgcaaagatataagtgatgggtccatcaatcagcctgctgcagaacggggccaatgctagataaagggagaatggggcatcaacccagaaaatgggattgggtgctggtttttcttccaagcatgaggtatatatcctatcacctacaaaagtggctcagattactgaatgttctagcactaagcaattcttatagacagtacaaagcctcataacttaagttgccaaaaatttatccatttcttgaaacaggttttggatcagctctgagaaagagttcttttccaaacaaaagcctaactacacaattaaatgaaagggaattcattcacttggaggagaataatgaaagaaaacaagttattttaaatgataaaaaatatgaaccaaattggcaacacctttagaatgattgctgctgggtttgattaatgggatacattatcagctgaacaaaaaaagagtttatcagtttagtacattttttacttaacctttcaatgaaaatcttaaaacttttttcagcatacaaaaataggaggaatggcttagaaaagaaaattgaaatgttccagaaaaagcaaaaatctaccctctgagataactgaccaccacttttaacagcctggtgtttattcccttggatttttgaatgtatatatatttttaattggatccaactatggtttttgtctttcagtatcctttatctccttctagctttacactttgcccctctggcttcagaagttgtcgcaccacttttcctccttggccacagtgattgctccaagcactagacacatgaacatagccaggccaatgagaatcctttccttagatttttcaactactggaactctgttcttctctagtcaaggagctacaagaatgtagtaacaggccaggctgcagttgctcatacctgtaatcctaacactttgggaggccgaggtgtgaagatcgcttgagcccaggaattcaagaccagcctgggcaacatggcaggaccccatctctacaaaaaaaatgaaaaattagccaggcgtggtgatgtgcacctgtagtcctaggttctcgggaagctgaggtgagagaattgctggagcccaggaggttggggctgcagtgaaccatgatcatgccagcctggataacagagcaagatcctgtctgaaaaaaaaaaaacaaaaacatgataacagagttggtggcaaccatggctccactgtcatggaaaagctgcaaacagtcagcagcagagacaaaaggcagagagaaagtcttggccctgagagcattcaggttcctgattccattgctaaggaccctgatgtcccagtcattcccaaagctcttttgtgcagttctttcttcaattctctgagtgactccagcattgttccagttcttataactgtcttacacccatagtaagttccatttcttactgaagctattccccatgattgtctgccacttgcagccaagagaatcctactatacatactcttctgcaatttgattttattcagttaaaattgtacatagcatggacaatttccatatcaatgcacatctccctcttccttttcaatggccgaataatagtcctttgtatggatgaatgtttatgacctttttctaaagccagaaacacaagaaggttttaaaaatggtaaacacagaaaattatactcagcttgaagagctgcagccacattaggagtggtgattgttatggaaatgagaggccagcattgatgaagtttaagtagcacttattccccaaccacccatgtagtactcatcaaacctgtcttatgcagagtaatttttggcatttgttatcacctctgcagatttctaaaagttatgccttgtatatgcaccccagtttccctgcttcacccagcattgtaaccataactcaaccactcattcacagggtcttcaaacctatttgttatagatgaacaaatatttgagtgaagttgagaggaggctgtgtttgcatgagttgttgagacctggaaccataagtacaattagtaccaagtttgaatccatctgaagttttgaagtccactgtttctgccatgcagtttccaagacatggatcaactttaataaagagttacacttgggcttcacagtcatacagtaatggggtcaagttccagttcctccgtttgtacgttgtgtggtcttgagctaaggctcccctctaagctgttttctcattagaaaaaaaaagagggttgattaatagtacttatctcataaataatttgagaagattaaataagaaattgtgtggaaagtttctatgactgtgctgcattcatagtaaatgcttaataaacggaggctagcatcatcttcttcatgatattcaatacattctgttgtccagggctgtataccgcttccaccttccaagtttttcaactgccaaagtgactttcagaaactgttctttaaagagctgggtgctagccaggaaacatttggaagcaaaaatagtcctaaaaataaggaaaggacgcatgactttttaaatgttgagttttcctttaagagcaaaattaaactgtgagtaaagatcaaaattcattctttctgtgaccttgttccaaagtgaggtttattggagcataatacatgtcagatgttgtttagagtggcatgtgcccttctcaggatatgttgaacatacgctgtgtgtctaggggtttttctagcaggtgttttggggctgaagagagaagaagggttcatttgacaacaacatccacagccctcaggttcaccctggattatgttcttcaaagtacaaacaggtataaaaaggataatttcctagatccttaaggcaaatagtttgtgaaatcgaattcaagggactttcccctgatgatattatggccttgggaattcagattaattgttcatataaaatacagaagaggaaaaaactgcagcatggattgggattcaatttaataccttccaagaaattgtcctcttcttgcagtttccattgcttaacaccttcttctcccaccactccaccttgttaacttctgttcttccttctgccacaactcagatggcattgcctgcagcagcactccctgagtcctctgttaggtgccgtgctatcaaatctcattgcccaccacacttcttcatagcacttaccaagaccatcatggaataactgactcttggactcagtgctttctcacccacacaactgtatgctccagtttcaccaggaatgggaccacttctatcacgttggccccattgccaggtcctttgtaatgatattataaatatctgaaaatcttgagaaaaaatttgatttattcaataaattttgactttagaaaacccaatgagtagctaatttgctaaggagttttccttatgatggtcagaagaatgtctttattccatgtaatgaaaaaaaaacccactatagctatttgatattgtattatcgacattctctgaacttatttggttatcagtttcaggaaagaaagtgataattataataattagctctaattggatgtgtaaatggctacattcaaaaaggaattgaaagagactcacgtaaaaggggtcttgaaagccataccttacctacctgcatagtcatgctacacaagggtggcagacaaaagccagagtgaacaaaagacaaaagccagagggttattgatgacactgctcaccccgctgaagcacctgcagcactgggtttcagtacgtcgactggaagaaacttctgagacagcttccccttctcagagccagctagcctctgcttggatcctctctgtgagaagggactcacttaacaccacgaggcagtccattccattattgaatggtttaaaggattgggtagtttcttcctacattaagacaaaaatgtgtttggctctaattccacccatcaaaatcattctgcatctggcagatgcaccaaggctaacaattttagttccagcataagacaaactcatttttgagtattactagctgtgtgatcttgggcaaattgcttcaccccctctgagcctcaatttcttaaactagacactaaatcttaacctgtagtcaaaattaaaaaataaattcatgtcaagcacgtagccccgtgcttgattcatataaagagagagctgtgaactctccatattctttcttctacatggcaagcattcaaatatcagaagacaatagccccatttagccttttttttttaattttttttattatactttaagtttcagggtacatgtgcacaacgtgcaggttagttacatatgtatacatgtgccacgttggtgtgctgcacccattaactcatcatttaacattaggtatatctcctaatgatcctaatgctatccctcccccttcccccaccccacaacaggccctggtgtgtgatgttccctttcctgtgtccatgtgttctcattgttcaattcccacctctgagtgagaacatgtggtgtttggttttttgtccttgtgatagtttgctgagaatgatggtttccagtttcatccatgtccctacaatggacatgaactcatcattttttatggctgcatactattccatggtgtatatgtgccacattttcttaatccagtctatcactgttggacatttggcttggttccaagtctttgctattgtgaatagtgccacaataaacatatgtgtgcatgtgtctttatagcagcatgatttataatcctttgggtatatacccagtaatgggattgctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgatcgccattctaactgctgtgagatggtatctcattgcatggtactggtaccaaaacagagatatagaccaatggagcagaacagagccctcagaaataatgccacatatctacaaccatctgatctttgacaaacctgagaaaaacaagaaatggggaaaggattccctatttaataaacggtgctgggaaaactggctagccatatgtagaaaggtgaaactggatcccttccttacaccttatacaaaaattaattcaagatggattaaagacttaaatgttagacctgaaaccataaaaaccctagaagaaaacctaggcaataccattcaggacataggcatgggcaaggacttcatgtctaaaacaccaaaagcaatggcaacaaaagccaaaattgacaaatgggatctaattgaactaaagagcttctgcacagcaaaagaaactaccatcagagtgaacagacaacctacagaatgggagaaaatgtttgcaatctactcatctgacaaagggctagtatccagaacctacaatgaactccaacaaattcacaagaaaaaaaacaaacaacccatcaacaagtgggcgaaggatatgaacagacacttctcaaaagaagacatttatgcagccaaaagacacatgaaaaaatgctcatcatcactggccatcagagaaatgcaaaccatttagccttttctaggctaactcctggtttctttggccatttattctataaggtgccttgtgacatctagctaattaggttacaatgaactcccagaattgaatcaagttctgcaggagatgattaattcaaactcgtagagctactgctcccaggtactctgaaggctgaggcaggaggatcacttgagttcaggagttcaagatcagcctgggcaacacagcaaggccccgtctccaaaaaagaaaaaagaagagctactgcagtggggaaagaaggtaacaggggaaacacctcagtttgtgcaggtgcacaagaggcatgtctttcccacgtctgcaccctaacattctatgtatgtagggaagatttcaaccatgttagcagtcccctcagactagtgacttagtacaaccgaactcttttaaaggtaaattttattgttcttgtgttctagttttaagagcagcatatgttcaatacaggaaatttttgcaaactcttgaaaagaaagaagaagaaaaatcttccatgatactatatccagagataaattgccattagcacttattgtgtcttttttcatttttaatttataggtgagttgatattcagcaacttccatttacatcttattggtttaataaggtaacctctagctgcaaaggaaactgggaaatatagtttcttttaagggtcactctgatgccttgaataaaattccggtttattaataaggaatatggggaaatgaatattgggagggcaactggcagtgtccgctgaacttgtctttttgaacatttctcttgttttcaatttgtctgtattataaacaatgttttgatgaatgccttgtaggaaaatctttgtacctatctatgattattccttagggcatgttcctaaaagcaactgtagggcttaaggatatgtgtctttcaaagctattgtttcatgttatgcaataattttttaagcaaacacagcatgcgacatttgttgttcttaaattttatctgttagattttaaaagcttagttatttggcattttagtgtgaattctgatctccttcccagatttatcctatttaaattactaataaaaagtcttggctgagtgtagtggctcatgcctataatcccaacactttgagaggttgaggcaggaggatcacttgagtccaggagtttaagaccaacctgggcaacatggcgaaaacccgtctctacaaaaaaagtacaaaaattagccaggtgtggtggcacatacctgttattccagctactcaggaggccaaagtgggagaatcacttgagtctgagaggttgatactgcagtgagctgagaccacgccactgtactccagcctgagtgacagagcaagaccttgcctcaaaaaaaaaaaaaaaaaaaaaaaaaaaaaaaaaaaaaaaaaaaaaacagcctgggtaaagggttctgtgacattccatgacagacctaccttcagtctaacactgagccattaaaaagccttctcggcacaattgtttaaggagccgtgacttcattttacgctcaattgacaaatgttttctgaatgctttctatacactaagcactgagctaggcaacatatgtacaggatgggtaagctctcattcctgccctcaaatggcctaaaactactgtccagctcacatttgccaccttgtccctatggatgcgcaagatactttgtcaaatgctttgtccatatcaggatatattttgcctataatatgcctgtgaaattctggtctgataatccaacccaaaaaggaaataaggtcaagttggcttcatttggccataccatcatacatagactttgccactcagatcataagcaatcatacattgcatttattttgtactcaacccttagctaagcacatgctcaataaagatctgttaaacgaattaataaataaatggatgtgtgaaaaagttcatatttactaattctgaaaccaaatgaggcttactgctctattaaaaagtacaataaacctctgtcttcattctgtgtatgaattgtgagcaagtatgtgtgaatgtatttgtaactgtgtgtgggggtgtgtgcaagtatatgtgtgtaaatatattgtgtcacttcataataaagtagtggttttataaaattctggagggttactccacagtagttattttataccctctttgttaattctaaaagtcatcgaaaagcaaaacatttaaataaagtaaatttagttatagactaaacccatagatccacctcattttttaatataaaacaagagatggaaaataatctaatgttttgtctattttgccaaaacccaaaatctttctcctttgggcaaggaaatactcacaccataaggagtaattctttaattgcttctaattaaaataaatgcccatgcactctgggtctctgggaacatgactaacacttgcctcaccttgcagatgaagcgtgggtaaggttgtgaaaatagtgggtatcacctcaacaccaccgcctcctctagccttacagctgaaatcaggcacccaccaatatcagtaggcccagggctctttccaacagcaaagtatgtgagactatcaaggaagctcagatattgagtcagttcttgaaacagatttttgcggaagtagcttagtaattagaagaccatggctttggagaccaaaagacccctcagccaggtgaggaaagacagacagacagaaagaaagaaagaaagaaagaaagaaagaaagaaagaaagggagggagggaagggaagggaagggaagggaagggaagggaagggaagggaagggaagggaagggaagagaagagaagagaagagaagagaagagaagagaagagaagagaagagaagagaagagaaggaaagcaaaggaaaggaaaggagaagagaagagaagagaagagaaaagaaaaagaaaagaaaagaaagagagaaaaaggctcagagagatgaggtgacttgcctaagctcacacagctagtaaggtcaggctctaactgggtcaaatgcctcacagattcaagctcttgaccaactgctagacaactgagcctcctaccatctgacatatttaaaacagctccagaatgcccaccccaaccttcaaacaagcagctgtctcttcagaaggtgctgcccacacagccataggatataaatttgtaccagcctactcggagtgggctgtggttggatgttccagttttaatcgtcaacagcagtgcccaagtagttctggccattcagtctactttgtgggagaaaaggcagctggcagtctgtcaaagcaaatgctgaacacataaaggcagaggttggggagcagatgtagtctccgctagtaacaaagattaaagaacatatttcttccgtgagaccagcatctaaaacataaaatgataaatgaacctcagcttctgagcagtggaaactttttccaggttatcaagaataacagcaatatatttaatatgtttttgagtatctgtatgcttcttccttgccttgatcattaatttgagaaagtacataattaaaagtaaacctattcatagcatcttcatcccaaggggctgaagcactttaatgtcataagtaagccaatgagatttatggctggtctctgcctttaagacttgccctttgaccttaggtgaataattgtaccactgggagttcattagaggaagtagaaaccaggactgctgaccctctctcattggctgtccacaggggaagacccagcagcaaacagataaggctttaatctgtcactgagtttcattatggtctgacactgttccctgttgcagaacatgtcctttgtagcatttacaagcccacaagaagctgacgttaatgaccgctggtagcacattttagctttccatttgtttgatttatttcatcctcctaacaaccttttgaggagcttagtgctgatattatccctatttgacaaataaggaaaatgaggcacaaggcttacctagtttacatgactgggaccagaattgggacctgtgacctctccaacctattcacagccaaccgtgcttatgcagagattgacttagaacccccatcttgaactctttttggaagtagatgtgatacaagccttaaataaatgaaggtgtatatgaaagctatgggtccaggggtggggaggattaaacactggagaactcttcagctgaacttgaaggactcccgtaataataacagagccagccaccactcattgaacaattgctgggtgctgggcactgagtcaagaactttacatggatacatcttctcatttagcactcgctacaactgtgggaggtgggacattatattccccatttgcaggataaaggactgtatcccacaaagtagctctccccagatctggacattccttatatcaaagccattactgctcaccaaaaccccatgctgttttctgtaattaatagattgggggaatgaaaggcatttcttaaaagtaactcagtggtctgaaccttaaaaacgcattatcttaagattttgcatgccaaaaagaaaaatcagtcaagtgtgttgaagggacatttaagttattcttacatttgtcattgttatatacagcatggcagagtatttaaccaggatggccagctttgaagcatgagagcctttctaagcctcagtttcctcattagaaaaatggggataaaattataccacctcataatgttgttttcagaattaaatcatataatatataaagcatttagcaccacttttttacatataggcaatcaatgaaaggtggctgctatcacatcatagtaatataatgatgttgcttaaaataaataggacagatactataacaagcaaaaggtatggaattcagatgatagctttttagtctattctatgctaacaactatttatttcctattgatgggtatttaattggtgctttttactggaagcttagatttgtgattttgtttggtgaggaggagtctgcagtgattgtatatacaatgatgatttcttctgcttgataaacagaaacccagaacagcaccaacagtggggtagaaaaatatgacttattagctattttactaatgcaaaatcagcctggggaatgccaatgcatcagatgaggaccatgcaggagatgccagcttttcttcatttcagaaaattatatcagagcatctaccaaacggcatccaaatgttcatagggttggccttgcttgtttaaggtaagaaataagtgtaatgggcagtcccaggagcatcccaagtctctcagtacccaactatgttgaaagtctatatcccaagcctctcaataccaccactatgtagaaagaaacagcagcagctccagctagctgtctccctgtcatgacttgatgccattggaaagttctggatcaccaggacttaccgatattcatcaagaagccagacagaaaagccctgcttgtctatgtcaatgttctgtcaacagtaacttgtctatagtcatctatcttttatggtttgagatcccattttcatacccattgtcttcataactttgggcaagttctttcccccgagtcttgatttcctcatccataagttggacaaaataacagaaaactcaaattccgtttagaaataactcaactttgggctggcagccaaggctcatgcctgtaatcccaacattttggggggccagggcaggagtaaggttcgatcccaggagctcaagaccaacctgggcaacaaagcaagacccctctctacaaaaaatttaataattagctaggcatgttggtgcacatctatagttccaactactcgggaggctgggaaggcaaaggcaaagattaggagagcgtttcagactgagaatggtgaagttctggcttagggatggggcagctctcagtttgtccaacagctgaagggaggcccctgcaggaggggttagattggaagagggagtggatgctgtgataagccatcccaatgcccccacctatcacctgcttcaagactgaggcactcgatcccctggcttctgctagcactggcgactgactgctcagctgatccttgtctgggaattcactttggctgaagagagctgcctagcctaaggacttggtcctccctgggggaagcctgcatgcaatgacaagtctatgatgtatgtggaatcggggggcaggtgttggtataaaggcctgaccccttccttgctgtaattcaagacaacttcagagcttcctgtgagatcagctgaggactttgccatgagtgcctcacaatgcaacttctccattggcccagtcctgcttttctcactgcccttccatgaggatcctgtgcactccctgctaagcttcctgcatgcaaatcttcatctcaggttcttcctggggaacccagagcagaagtggaaaggacatttgcaggaactattccagtagcacaagcaaaaaacaaagaggggttggactagaatagtggttttggggatggagataagcagacaaattttagatgaggaggtagaggttggagaatataaggttatttgaaggtagggaagctgaaagcaagacaggataactaacaatgctgagtctgaggcaaaaggaaatatcagtaatagcgatcttatgtttatttaaaattattgcattttgttcaccatgggggttttttggcattaattttgatttttaaaaatattgcttctctttcctgctgagtgttttggcatccccttaaattttgcactccagacttgtacctcacttacttcaccctagtcctggccctgaaaatgtttatcttaagacactaagttttggaattatttcatttttttttaaatttaaggtttcttttaagagacacatgtctcactatgttgcccaggctggtctcaaactcctagcctcaagcagtcctcctgcctcaatcccctcctgcctcaattcccactacacctgggtctggaattgtttcttgcatagcaataggtaactaatgtgctagcaaggagtcctttggaaatttacttaatctctcaaagccttggtttcctaatctgtgaaacagggataaaagcatatttcctatggttattttaatgattaaatgaaatatttcagagaaagcccttaacatagtgaccatcacacagtgtttcaattcaatgtgtccacaattgtcatcaatgaaatcacaagagtgagatcctcattttaagatcctggagtaatattatcatttttttcaaaatactaggcagaacttcctgttctgtttcttaaataagtttttctaaatgttctctcttctaatggtctttgtgggcataaatttaagtatgaaagatagtgcctagttgcttaaaaggcaactggtaatgcttactactctgaacgggaacaggacaccctgagttactcttttaattactattcacgtttattgaatactcatgaagtgtcagggctctgggacaagggcatcattcattttgatatttaatcccacaggccacctacaaagtgagcattccccatttcccccaattaatccccattttacagatagggaaactgagggaggcctagagaaggtaaacattttgtacaaggtcacagctggaaggcattgttctcaaggtctctgcagcctgtgtacagtttgcaagtggaagtatttctctcaattccagctgtgcccttgattgggcaaattacttttccatgacccacagcaaaaattacatctgggtgtctcacccaaatgtaataagggtgtttcgcccattaagggttagtcctttgaaggatttctctattaataatatgaattgtagactgacactgagtcagcacgttgagtcttactggtatccccgcttctgcatgaataacagcatgtgctgagtaagaggttcggagctgctttaattccctccctgtggctttcgcctcaagaattggcttactccactgctgtggcctgatatgccagcacaacacagcagccttcttgggttgcaggactccaattttttcagtaccttatggtctcctttgcccttgaactatggatatcgacttttcactttaatgcacattatctagagaaattcaaagccaaagaaaaacattccacaagacctgcctctgtaggaattggaatagagtaggaaatagaaaagtttgtgtgagggccatgtttgttcccacgagtccagacttccttgcacagctggagggcttctcttggggagactcaacatgagccaaaacatctggacttttcgctttaaaaaatctggtgtctgccatctacaagccatagtatacatttttgttctttatatttagtaaaataagaaaccttttgggagaagagctcattgtcttagtgcaggtcattaagtatttgctaagcacagactatgttgcctgccaagcactcatcatttgtcttgtgttccagcgtttcaagaagtttaaaatcagatccaattaaaagtgatgcccctctaaagaggcataaatgtccttatccaagaaaacaaaacctttgaccttctgtgttgtagaaatcctgcacagtgatagaagcttatgtacaacactatgcttataacagggggaaaggaattgtttatgcacattgaggttcaacttagcatcagtgattcattccacactgtcaagagtgtttaccaagcactcttcctgaaaggtctctgccagctggagaagtctctggcgtataattcacagaatcttatacctggacagggtttttgaggtcatctcatcaaatactatcccagtgcagggcttcctccctgaccttctgacagatggtgtgcacattcagccactactccagcagcatctttcctccaaccttcccctggtcctgtgcacaatccactgctaccccactgagtctctgtaatgtgaactgaattatgtccctcccaaattcaaattatgtggaagccctaacccccaatgggactgcatttggagatagagcctttaaagaggtaattaaggctaaatgggttcataagagtggggccctgatccagcctgactggtgtctttgtaagaagaggaagagacaccaggggtgtgcacacacacagtaaagaccatgtgaagaggacgcagcaagaaggcagccatctgcaagccgggagaatccgaccctgccagcaccttgatcctagacttccagactacagatctgtgaggaaatggacttctgaggttttttgggttttttgtttgttagttggttggtgggtttcagacggagtcttgctctgttgcccaggctggagtgaaacaatcccggctcactgcaacctctgcctcttgggttcaagcgattctcctgcctcagccccccaagtacctgggtctacaggtgtgtgcaaccatgcccggctaatttttgtgtttttagtaaagaccggatttcaccatgttggctgggctgggctcaaactcctagcctcaagtgatccgcctgtctcagcctcccaaagtgctgggattataggcgtgagccactgcacctggtggaatttctgttttgaagccacccaatctttggtattttgttctggcagcccaagctgactaagacacttccttctagagttttttggccttctacccagcctgcctctttggtagtttacactgtcctgtttttagtctttatatgagatttaagcctattctaataatgctcccttgttcacactttgctttatcagtatgtgtctcatctcccaaagcacattattaactcataggaaaaaacaatcaggttaaacaagcctctttttttctgaagtgcctagaaggaagcagtatagactctggggatttaataaatctgaattgcttaaataaatggtaaactactcctgctagtcggcagttacgttcctcagatacattaatcctcagttttcacatctgtaaacaggtaataaattctgtctcttaaatagaatgtatctgatgagattgcagtgaagattaagttagataaatttgtctggcatatagtaagtgctccattaaaagagaattattattattattttattgtaaagccacacctgggaaaaggaaagtgatctcacccaaaaggtataaaatcgctgcggattcagttctgcagtatatgaagaagtatatgtctcttgcctttcactttttcttgttttgagatgagccacacagcattgtactggttagaagagataaatgatggaacccaggttcccctctctcttcactggcactccagggtggaatgctttttacctcaataatgttttctagccccattagttgttacgtttctgtttgaatagcaatgtgatgcatccaaagcatcaactacactatgttctatttactaaatgcattaaacgtaaggatgaagaaacgttaaaagatggacttgccaaacatgattctgagcaaactgtaccaaaagacaactaacattttattagaaaacttctaattaccacatgcaggcaatcctgtcacaggatttcagcctttgtggtgattcattctccccaccccatgacacaagttggaggaattatccagtgattgtacagtttgcaaacattaatgaatctggtgccttagatcatgtttatgaataatctgttgcaatactcaccctttcatttggaatctttgcaaaggattccttttgtgtctggtccaggaatccttccaatgctaaacagactttccacttcccaaaacctcactatcccttctgatatggtttggctgtgtccccacctaaatctcgtcttgagttgtagctcccataattcccatgttgtgggagggacccagtgggtgataattgaatcacgggggttgttcccccccatactgttctcatggtagtgaataagtctcacatgatctgacagtttataaggggaaacccctatcacctggttctcattctctcttgtctgccaccatgtaagatgtgacttttaccttccaccgtaattgtgaggcctccccagccacatggaactgtgagtccgttaaacctcttcttctttataaattactcagtctcaggtatgtcattatcaccagggtaaaaaaggactaatacgctttctaaggtcaagagcttaatcaatacaaattgaattttgcataagtcaatttaaagatgactcttataagttaatacagacctaagctatgtattctcagatctttggattcaatagaccagtatctaaagcctttgttagtggtttatatatccatagctgtctgttatgataacttttgcagaattgacatgcgaactgatcgattaagctgccaggagacttttgtgatttgattctcaatgaaaaattttgggggtaatatccatctcactttttttttctgagagggagttttactctttttgccaaggtcggagtgcaaataatggtatgatctcagctcactgcaacctccgcctcccgggttgaagcgattatcctgcctcagcctcccacatagctgggattacaggcatgagccaccacactcggctaatttttctatttttagtagagacagggtttcaccatgttgttcaggctggtctcgaactcccgacctcaggtgatctgcccacctcagccacctaaagtgctgggattacaagcatgagccaccatgcctggccccatctcacttttaaaaaatattctaataaagtccttggctggcaaccagaaggataaaataaaaagaatcaaattatctagtggtgttaaatataaaacggaaaggaataaaaatttaaaaggatacagacacagggaatagtaatattccctgcctcaatattttggtttacacagttcctttttatctttttaaaagtataaatagtacatgcctattgtatgatacaaatgtgtaccaaacagtgaaaaggccctccactttcccctggtagatcagtctttcaataaaacctaatgttaatactttagtgtatggccttctagattcttctgtgcatacatctacaaatgtatttgcctcaatagattatactatgcataccattctctgccctatattttttaatccaacaaaatattgtggatatgtttccttgcctattcatataaatcaatgttctgaatgactgcatagtaattgctgaaccacaacttatctcctactgataacatttacattggttctaatttttttaccataacatcagtggtataatttctgcatgattgtaataaaaagatgcttcatatttatttatacttctttaagttaaatttctaacatagttttgccgggtcaaaaagaatacccaggtcagacacagtggctcacacctgtaatctcagcactttgggagacagaggtgagaggatcacttgagcccaggagtttgagaccagcctgggcaacatggcaagaccccatatcttaaaaaaaaaaaaaatggctgggtgtggtggcacatgcctgtagtcccagctgcttgggaaactgagatgggaggattccttgaacccaggaggtcaaggctgcagtgagctgtgattgcaccactgcactccagcctgggtgacaaagtgaggctctgtattaaaaaaaaaaaaacaagaatacctattgatattttgatagattctgccaaattgccctctaaaaggttgcaacaattaaaaccctcaggagtaatatacatccatacttatttgcccaatccttcagaaaatttgggcaacgtagataattttcatttttatagatttcttatttttacatttgaatgtataatcttttataaaatagtaagatgaagagatgaagggccttgctattgtttacaaactatgtgacaacagactttaaagtttaggttttttaagttaattcaggcaataaatctttaaaacaaaaaaaaaaatctcaggccaggtgcagtggatcatgcctgtaatcccagcactttgggaggctgaggaaggaggatcacttgaggccagtagtttgaggccagcctgggaaacacagtgagaccccatttctataaaaaagattttaaagattagccaagtatggtgatgcatgcctgtagtcttagccacccaggaggctgaggcaggaggatagcttgagcctaggagttggaggctgcagtaaactgtgattgtgctactggactccagcctgggtgacagagtgggaccttgtatcttaaaaaaaagaagttaaaaacaaacaataaaaaacatattatcttctcttcctagaccacatcctttcgcaaccatttgagaactaggtaaaaattatcagtctctattgctagctgaagctttcaccttgactgggcttccaccatcaccaggtttgattgcaaagtgtcatttcttttcttgggtgagaagcatatcaaaatactatcacttgcttaccctgccccgacatgctaggtttgattcatgttggaataatagaaaggactaaagaattcagagcagttctgtactctcgcctgacacctaacaccaatcggtttccagcccacagagctgtgcagtggaatctccaaggcacattctagattccctagtgtcactccagtgagcaacctttctacacacttcagcacctggacagctctcttggcaccacctctagagggcatggtaagccgctttgttgagccctctagtggttgctttagttattgcacaactgtttttaaaatttcaggtgtacctcggagatattgcaggttgggttccagacaaccacagtaaagctagtatcagaatagctctggttctgcagtgcatataaaagttatatttgcactgtactgtagtctattaagcgtgcaataacattaggtcaaaaaacaatgtactgacttggcaaagtggctcacacctgtaattccagcactttgggagacaagggtgggaggatcacttgagcccaggactttgacactactctgggcaacacagtgagaactcatttctttaaaaaaaaaaaaaagattaaaaattagctggacatggtgctgtgcatttgtagtcccagctgctcaggaggctgaggtagggggatcacttgagcctgggagattgaggctgcagtgagctatgatcatgccactgcattccttcctgggcaacagagtgagaccttgtctccggaaaaatgtacataccttaatttaaaatattttattgctaaaaaattgctaatgatcatctgagcctttagcaagtcataatatctttgctggtgaaggttcttgcctcagtgtggatggctgctgacagatcagggtgggggttgctgaaagttggagtggctgtggaaatttctttaaaaaagacaacaatgaactttgttgcattgattgatttttcctttcatgaaagatttatctgtagcatgtgatgctgtttgatagcattttacctacagtaaacttctttcaaaattaaagttaatcccctccaaccctgctgctgctttatcaaataagtttatgtaacattctaaatccttttgttgtcactgcaacaatgttcacagcatctttgccaggagtagattccatctcaagaaacaagtttttttgctcatccataagaatcaactcctaaaccattcaagttttatcatgagattgcagcaattcagtcagaccttcaggctccacttctaattctagttctcttgctaattccaccacatctgcaataacttcctccatggaagtcttaaacccctcaatgtcattcacgagggctggagtgaacttctttcgaattcctgttcatgttgctattttggcctccttccatgaatcataaatgttcttaatgacatctagaatcctttccagaggattttccatttattttgcccagatccattggagaaatcattatctatggcaactatagctttatggaatggatttctacaaataataaggtttgaaagtcaaaattactcctggatccatgggctacagaatggatattgtattattagcaggcaggaaaacattaatccctttgtacgtctctgttgggattcactcaggatggtggcagaaatattaaagggaaatattagggaaagttatagggaatagtcacaaacctctctggaaggctgaaaggttacatagcttgtaataattgaacaggctgaaggctgccggttcttaccttagagcattaagtcataggttaaatactagggacaatagaggcttccccagttaagtctgtttaccctacctccattaactaacctttgagccagatggccctgggggggtggcgggagaggtctaccaggaaaattgcccccaatggtatttactttagaccacagtacctgagctttaatcattcgtagaactactctcttaaccatgttaattatccacaagtgtgttgactcaaagcttccattgttaattctacactaaataaatgcctggagtgcgaaccgttcagggcaacacctgccattctttacaggactcttcttggagtctgtgagtggcctcggaccctcagctggactggcaaagcagaatatctgtgtgtcagtgtatgtttattcatccgtcaccaaatcaggggtctgcaggaacagaccctctgcagctagtgctcccaagaaaggagcgctgcctcacatctccatcacagctcatgggtaaccagatgctttgtgaatgagtggtaatattttgaaaggaatatttttttctgagcaacaggtctcaagagtgggcttaaaatattcagtaaaccatgttataaacagatatgccttcatccgggctttggttttccatttgtagagcacaggcagagtagatttagcttaattcttaggactttagggttttcagaatggtaaataagcattggcttcaactcaaagtcaccagctgacttagcccctaacaagagagtcagcctgtcctttgaagctctgaagccaggcattgacttctcttctctagctgtgaaatttctagggggcatcttcctccaatggaagtctgttttgtctacactgaaaatctgttttttagtgtagccactttcacaaatgatcttagctagatcttctagaaaacttgctgcagcttctccatcacttacagtttcacctttcactttcgtgttatagaaacagcttcttttcttaaacctcattagtcaaactccgttggtgtcagacttttcttctacagcttccttacttctctcagccttcatagaattgaagagagttagggccttgccctggattaggttttggtttaaggaaatgttgtggctggtttgatcttctatccagaccactcaaactctctccatatcagtgataaggctgttcaccctcttatttatatgttcactggagtaacactattaatttccttcaagaacttttcctttgcattcgcaacttggctaactgtttggtgcaagaggcctagcttttggcctgtgttggctttcaacacgcctgcctcactaaatttaatctagatattaaagctagaaatagtttctgatttgaagcaagagatctgcgactcttcctttcacttgaacaccaagaggccactgtagggttattagttgatctgatttcaatattgctgtgtttcagggaatagggaggccaaagaagatggagagatgcaagaagacccggtcaaacttaatttaccaattaagtttgccatcttacatgggagtagttcatgatgccccaaaacaattacaatagtgacaacaaaaatcactaattgcagatcaccataacagataaatcataatgaaaaagcttgaaatattgtaagaacgaccaaaatgtgacacagagacatgaattgagcacatgctgttggaaaaatgacaacaacagacttgctcaaggcagggttgccacaaactttccatttgtaaaggacacagtatcaacgaagctcaataaagtgaagtgcactaacatgaggggtgcctttattcagataacacatgaaaatgttataaaacatccaaccattagggctgggtgcggtggctcacgcctgtaatcccagctctttgagaggctgaggtgggtggatcacgaggtcaggagatcgagaccatcctggctaacatggtgaaaccccgtctctaataaaaatacaaaaaaattagctgggtgtggtgacgggcgcctgtagtcccagctactcgggaggctgaggcaggagaatggcgtgaacccgggaggcggagcttgcagtgagccgagatcgcaccactgcactccagcctgggcaagagagtgagactccgtctcaaaaaaaaaaataaataaataaagccaagcatcttaaaaatacagagtaaatgtgcaagttcctattatccttcctctcctactttccttggaagttagcactgataaaacacaagacatacatatatttacttaccaacaccttttgttttgtgaatggactcattctaggcccatttgcttttatttttagttaacaaaattcctaggcgattttttaaaatctcagtatacatatctcttacatattcttgtaagacattatggagaagcggctggctgtgtgtgctagcctccgactagtcatgatcctgattttgccacttcctaattgtctgatcttgaccaaatcccttaaactctgtgtgcctcagttattcatctgtgaactagggataaaaaaagtatgcgtcttagagtggtggaagggaagagaaatgataaaatataagtaagcatttagtaaatttagcaacttttcttcttttaagagacaggttctcgctctgtcaaccaggcgggagtgcagtggcatgatcatggctcactgaaactcaaactccttggctcaaatgatcatcccacctcagcctcccaagtagctaggactgcaggtgagcaccctgccaaggtaatttttttttagagacgaagtcttacaatgttgctgaggctggtcatattattattttattactattaattatatattagctggtacataatattccatagtgttctgggctacatatttgtgtaccctgagaattcctgttgaaatcctaaacctcaatgagatggtttcaggagatggggcctttgggaagtgattagttcatgtaaatcctcataatgggtttaatactcttgtaaaagagactcccccgcaaaaaaacagagacctcagagctcttggccctttctttaagaagacagcaatatatgaaccataaaatggtgctccccagctaccaaatctgctggcaccttgaactaggacttcccagcctccagaactgtatgaagtaaatgtctgtggtttaagccacccagcctatggtacttttgttatagtagcctgaactataacagggattttgtatcataacttatgcaactatgtttctgtaactaagaaacatagtatggatgtatcataaattatgtagtaactaccttattaatggacacttgagttgttttctagttttctctattgcaaacaatattgtaatgaacactctagcatatatgtctttatgtccatatttaagcaagttttttaagatctattcccagcaggagagtgaaaatcagttaacttccaaagtctcctggagttcacagctttgattgatttgtacatgggtgctaaattaagagagataaaaactgagagacaatctctcctagagagatacacatagtgttggcataagtactatgaaaaaaattaaaagctgtgtgagtggataggagggaattggggaatgatgtgtgggacactctagataacaaagacttctccatggggatgaaattagcaaagggacctgaatgaagtaaaagactaaacacagcaaatgatttacaaaatatgtgggaccagcagccaggcaccgtggctcacgactgtaatcccagcactttaggaggccaaggtggtcagatcatttgaggtcaggagtttgagaccagcctagccaacatggtgaaacaccatctctactgaaaatacaaaaattagccaggcatggtggcacatgcctgtaatcccagctactcgggaggctgagacaggagaatcacttgaactcaggaggtggaggttgcggtgaggtaagatctcgccattgcactccagcctgggcaacaagagcaaaactctggctccaaaaataaaaataaaaataaaaataaaaaattagccaggcatggtggtgcatgcctgtagtcccagctactcaggggactgaggcaggagaattgctggaacccgggaggtggaagtggcagtgaccccagatcgtgccattgcactccagcctgagtgacagagggaaactccatctcaaaaaaaaaaaaaaaaagtggaactaggaaacaatcctgactttctggtcctttcgtcccatccccaggggaagcaaatcctgtgtctacccctctgcctatcctacttcacctatacgtggtcttgccttgtcttggggttcccccacatgtctgtcttatcctaccttgaacataatctgtttgcaggcagggcttaattccatatgcttagtagtcccacagtttcccaccaggacagggtcctgggttgtatattccataggcattcaaatgttaaatggctcagatgaggcagctgctctaattaaataatccctgaagttcttatgcaacatggcccttgggctcttgtattcactgagtagaactcagtgacaggggaacctgactggggggcattcagatgtgtattctgcagttatcagtattgtgaacagaatgaattttttaactagcacctatgctttagccaaagaaggctatttcatgctggagcagtctgttagatgtggagtccatgcttttaggtagaggcctagagttatctgagggtttatagaacgtattttgcacttgtgtgttttgttttgggtttcaattgtaccaattcggatgctttgggctccaagcaaggaaaaaacaaacttaaactggcttaaaaataaagaaactgtattatctcatgaaacaattcttcaggtgtttgactccatgggggtaatttatttgggtattcaaagacaccatcgatccagattctttttatttttctgcttttctgtcctccataaggcaaggtggccctctgatcatgagatcaggtcagcttctctcatgatctcaaggtgctaccacacttaggcagatatgacaatatccagcaaaaatataaaccaaacgagggactatgccttagggtgtatctcatcctctaggaaaacttagaagctctcaagatttttcacttctgattacccataactgagtcacatgtgcatgtttaagtcaatatctgtcaagggaaggggcctaccaccattggcatgggtgacagggattcagcccatttctcacggaggaaggtggatacctaaaccaagctggagtttcgttagagaggaggaaggcataaaggttgttggggtttgggtactacattagcttgctagggtaactgtaacaaaatactagagactaggtggcttaaacaacaaaaatttattttctcacagcttcagaggctagaagtttaagatcaaggtgtcggcagagttgatttcttctaaggtctctcttattggcttgtagatggccatcttctctctatgtcttcacgtggtcttccctttatatatgtctgcgtccaactttcctcctttcataaggacaccagtcctatcaaattaggcccacccatataaccttattttaactcaattacctctttaaaattgctatctccaaataatcatatcctgaactccagcatgtgaatttggggagacataatcagcacttaacaggtaccagtgatgactgccactagttatttgcagagcatataaagaaccaaaaagaagaaaatccaaattacttgtaatctcatcacccatagggacccactctatataccttctagtcatttcttatgtgtacacagctaacacagacatacgtcctttttaacaaaataggatcctactgtgcctactgttttgcagtctactttttttttttttttttttttgagacggagtctcactctgtcgcccagcctggagtgcagtggtgcacacaatctcagctcattgcaacctccgcctccccggttccagcgattctcctgcctcagcctcccaagtagctgggactactggtgcatgccaccatgcccagctaactttggtatttttagtagagaccacattggtcaggctggtctcgaactcctgacctcgtgatctgcccaccttagactcccaaagtgctgggattacaggcatgagccactgcgcctggcagcagcctacttttttatttcatcatatcttgaacatctttccatgtcaattatattttttaacatatggatttaccactgttttcttaactaatatgtgttcttaggtacttagggggtctccactttttattataaacaacactgcaatgaacatctttataactagatcatgttgcatctctatcattactttttataagatcaattcctagaagtggaatttgtcagttaatcttccctgaaatgctgagtcaggaagccccaggctttacagttgtcgtgtcaccacaagttaccttcaccacgaaatagagacccagaaaaggcagagaagaccccagggagttgctcctctgctccacaggattcttttagcccccagagagtgaaggatctgtcattcattttttcaccccacgttttgctttataattaaagaaacatgtacaaaaaatgcatgttttaggggccaggaagcaaagagcttcacattcatgctactttatcatcatgcttttataaataagtttctaagtctaaaaagaaaacaaaatatacacacatccccatagaaaaatcttccatgcctgggatataatgtgagcaccagaatggggtgatgtcttagtccattcaggctgctataaaaaaataccacaaacagggtggcttatgaacaacagagatttatttctcacaattctacaggctgagaagtccaagatcaaggcaccagcagatttagtgtctggtgagggcctgctttttcacagatgcgaccttctctctgtgtcttcacatggtggaaggaaaggcctctccagggcctcttacaaggacactagtgccattcatgggggttctacctcgtgacataattacctcccaaaggccccaccataatcacctcgaaaagttccctaataccatgacattgggggttaagatttcaacatattaattttgagggtagggaagacataaacattcagtccattacacagaaagcacacagggcagggtgtgggttaatttaaatggttggctctggctctgtgattctatacactggttctctcatatgtcactgtcaacgacattcatttgcacaacaataaaaatgatatttgacataagaggctttctggaaggttaagtctttacatccatattaggtttatttccaaatattgaaaatgaccatagaataatgttgttatttataaagtctctttctaataattcttatttgaatttttagatcagttcttacagtcattttttctgaaaggacttttacgtctgcagagtcaaatgcgccctctacttaaaaccgcctaccatcctcaaaataataaaaactggacgtaagctgtctgagggcagggccatttctgttttgttcattgcctggagcatagttgatgtctgatgaatatttgtaaagagaaaaaataatgatgcataggtagcatttacagagcacttggcatgtgccaagaaccgtgctaagactgcacatacattatctcatagcagtcccataagggaagggctatcatttcctccaattaaacataatgaaatagaggctgaaaggggtttttaaaaattttctcttggctgggcgtggtggctcatgcctgtaatcctagaactttgggaggccgaggcgggcagatcacgaggtcaggagatggaaaccatcctgggtaacacggtgaaaccccatctctactaagaatacaaaaaattagccaggggtggtggtggacgcctgtagtcccagctactcgggaggctgaggcaggagaatggcgtgaacccaggaggcggagcttgcagtgagccaagatcgcgccactgcactccagcctgggtgatagagcgagactctgtctcaaaaaaaaaaaaagaaaagaaaagaaaatttctcgaagtcagatttttagtatgcagcagagttgaaattacaatcatggtctgaattctaaatatgtactcttaactatgagtctatgaagaagaaattcaaaatactagtaacactcagcaccttaacagaggataatcccaaaaagaagccatagaattgaagattttgagtgctatatgtctatctgtatttccaagagcattatgaaatgaatcatcctcaccaatcattggacaattcattatttcagtcatttcaacaaggcaacaaccaattggcatagtacatttatttttaaaataatcaaggattatgtaaaaattctaaatatatatgagcacctagatatataaagcaaacactattagagctaaagagagaaatgaccctaacgtaataatagctggagaccccactttcagtggggtaataatagctcaacaccccactttcagcattggacagatcatccagacagaatatcaacaaagaaacattggactttatctgcactataaaccaaatggacctgatagatatttatgaacatttcatccaacagctgcagaatacacattcttttttctgtttgtttgttttttgagacaggatctcactctattgcccaggctggagtgcagtaacacaatcacagctcactgcagcctaaatctcctgggctcatgcaagccttcttttttttttttttttttttttttttttttcccctggacagggtctggctctgttgcccaggctggagtgcagtggtgctagctggttcactgcaacctctatctcctgggttcaagtgattctcatgcctcagactaccaagtagctgaggctacaggcatgcaccacatgcctggctaatttttatatttttagtagagacggggtttcaccatgttggccaggctggtcttgaactcctggcctcaaatgatccaccagcctcagcctcccaaagtgttgggattacaggcatgagccaccatgcctggaccccttaagcgaggactgagtagcggggaatataggcatgcctcaccatgcgtggctaatttttgtattttttgtaaaagagatggggtctcaccttgttgcccaggttggtctcaaactcctgggctcaagcaatccacctgcctcagtctcccaaagtgttgggattacaggcatgagccacagcgcctgcccagaatacacattcttctcctcagcccatggattattctcaaggatagaccacaaattaggccacaaaacaagtcttaaaaaattgaaattgtatcaagcatcttctttgaccacaacggaataaaactgtaaatcaataacaagaggagttttggaaactgtacaaccatacggaagctaaacaatatgttcctgaatgaccagtgggtcaataaggaaattttaaaatttcttgaaacaaatgaaaatggaaacataacataccaaaatctatgggatatagcaagaacagtactaagaggaaagtttatagcaataagcaccaacatcaaagaagcagaaaatcatcaaataaacaacctaatgatacctcttaaagtattagaaaagcaagagcaagccaaaatcaaaattccaagaagaaaagaaataataaaaatcagagcagaagttaatgaaattaaaacaaaaaaatacaaaaaatcaacgaaacaaaaagttgattttgtgaaaagataaaagacaaacaaaattgacaaaaccttagccaggctaagaaaaagacaggatccaattaaataaaatcagagatgaaaaaagagacattacaagtgacactgcagaaattcacgggatcattagagactactatgagcaatgatatgccgataaattggtaaacctagaagtggacaaattcctagacacatacaacttaccaagattgaaccatgaagaaatccaaaacctgaatagaccaataacaagtaatgacagtaaagtcgtaattaaaagtttaccaacaaagaaaagcccaggacccagtggcttcactcttgtattctacctaattttttttttttttttgagacagtcttgctctgtcacccaggctggagtgcggtggtgcaatctcagctcactgcaacctctacctcccagattcaagcgattatcctgtctcagcctcctgagtatctgggatttcaggcacccaccaccactcccagctaattttttgtatttttagaagagacgggatttcaccatgttggccaggctgatctcaaattcctgacctcagatgatccacccccatcagcctcccaaagtgctgggattacaggcatgagccaccatgccctgcccctaccaaacatttaaagagggactaaaactaaccctagtcaaactatttcaaaaaaatcaagaaagtgggaatacttccaaactcattctacaagttcagtattatcctgataccaaaaccagacaaagacacaatgaaaaaaaataaaaactgcaggccagtatctctgaggaacatagatgcaaaaatcctcagcacaagactaataaaccaaatttaacaatacactaaaaaaaatcattaatcacgactaaacgggattcatcctagggatgcaaggatgattcaatatacacaaatcaatgaatgtaacacatcatatcaacagaatgaaggacaaaaactatatgattatttaaattgacactgaaaaagcattcaataaaattcaacatttatgataaaactttatgataaaacctctcacaaaatggggtacagaacaacatacctcaacattataaaagccatatctgacagacccatggctaatatcatactgaatggggaaaaactgataggttttcctctaaggtggggaagaagacaaggatatcaacttttaccaccattattcaacatagtactggaactcctagctagaacaattagacagaaaatgaaataaagggcatccaaattggaaaagaagaagttaaattatccttctttgcagacaatatgatcttatatttagaaaaacctaaagactccagcaaaaaactgttaggtctggtaaataaattcagtaaaattgcaggatacaaaatcaacatacaataatgaatagcatttctagatgctaacagtgaacaatctgaaaaagaaaccagggaagtaattccatttataatagctacagataaaataaaatgcctaggaataaacttaaccaaagaaaaaaatctctattatgaaacttacaaaaaacattgataaaaaattaaataagacacacaaaaatggaaaggtattccatgttcatgggctgggagaatcaatattgttaaaatgttcatactatctaaagcagtgtacagatttaatgcaatccctatcaaaatactgatgacagtcttcacagaaatagaaaaagattattaaaatttatatggaatcacaaaagacccagaatagccaaagccaccctgagcaaaaagaacaaacctggaggaattgaattacctgacttcaaattgtactacagagctacagtaatcaaagcagcatggtactgacataaaaacaaacacatagaacaatggaacagaatagagaacccagtaataaatccacacatctatagtgaactcattttttacaaaggtgccaagaacatacactgggaaaaggatagcctcttaaacaaatgatgatggaaaaaaatggatatttaggacagcaatttttaaccacaggcaatttttctccccaggggcacatgtggcaatagttggcaacacgtatggttgtcacaaccggggaaggcacctactggcatctagtggttagaggccagggatgctgctaaacattctacaagagacaatgaaactagacctctagctcttgccatatacataattcaattaaaatggattaaaggcttaaatataagactgatgctatgaaactcctaaaagaaaacattgagtaaactctccaggacattgttctgggcaaagatttcttgagtaatacctcaaaagcacaggcaaccaaagcaaaactagacaagtgggatcacatcaagctaaaaagcttcctcacagcagaggaaacaatcaacaatgtgaagagccaagccacagaatgggagaaaatatttgcaaactactcatctcacaagggattgataaccagaatatacaaagagctcaaacaactctatagaaaaaaatcaaataattatattttaaaaagggcaaaagggcctgggtgcaatggctcaagcctataatctcagcacttagggaggccaaggtgggtggattccttgagcccagacgttcaagactagcctgggcaacatggcaaaagcctgtctctacaaaaatacaaacattagccatgtgtaatggcgtgcgcctatagtcccaggtactagggaggctgaggtgggaggatctcttgagtccgggaggttgaggttgcagtgatccatggtcatatcactgcactccagcctgggcaacaaagcaagactccttctcaaaaataaataggccaggcgtggtggctcacgcctgtaatcccagtattttgggaggccatggcaggcggatcacaaggtcaggagttcgagaccagtctggccaacatagtgaaaccctgtttctactaaaaatacaaaaaattagcaaggtatagtggtgtgcacctgtatctcagctacttgggaggctgaggcaggagaattgcttgaacccagaaggcggaggttgtagtgagccaagatcgcgccattgcactccaacccaggcaacagtgtcagactctgtctcaaattaaataaataaataaataataagtagggcggggcgtggtggctcacgcctgtaatcccagcactttgggaggctgaggcgcgcagattgcgaggtcaggagatcgagaccatcctggctaacatagagaaaccccgtctctaataaaaatacaaaataaaattagccgggcgtggtggcgggcgcctgtagtcccaactactcgggaggctgaggcagaagaatggcgtgaacccgcgagtggaggttgcagtgagccgagatggcgccactgcactgcagcctgggggacagagcgagactctgtctcaaaaataaataaacaaataaataaataaatattaaaagggcaggccggacatggtggctcatgcctgtaatcccaacactttgggaggccgaggcgggcagatcacaaggtgaggagatcgagaccatcctggataacacggtgaaaccccgtctctactaaaaatacaaaaaattagctgggcgtggtggcgggcgcctgtagtcccagctactccggaggctgaggcaggagaatggcgtgaacccgggaggcggagcctgcaatgagctgagatcgcaccactgcactccagcctgggcaagagagggagactcggtctcaaaaaaaaaaaaaaaaaaaaaaaaggcaaaagatctgaatagacatttctcaaaagaagacatagaaatggacaagaagtgtatgaaaaaatgtttaacatcattaaccatcagagaaatgcaaatcaaatctgcaatgagatatcatctcatcccagttaaaatggcttttattcaaaagacaggcaataacaaatgctggcagggatgtggaggaaagggaaccctcgtacactgtcggtgggaatgtaaattagtacagctactgtggagaacagtatggaagttcctcaaaaaactaaaaatagagctaccatacgatccagcaatcccactgctagggatatatccaaaagaaagaaaatcagtatatcgaagaaatatctgcacttccatatttatggcagcactattcacaatagccaagatttggaatctaaatgtccatcagcggatgaatggataaagtaaatgtggcacatatacacaatggaatattattcaaccattaaaaaagaagatcctgtcatttacaacagcatggatggaactggaggacgttacgttaagtgaaacaagccatgcacagaaagacaaattgtgcatattctcatatgtgggagcccacttagcccctggtaatatatattgttaaaattaaaacaatggatctcacggaaatagtagaatgatggttaccagatgctgggaagggtagtgaggataaactggggaaggttaatgggtacaaaaatatagttagatagaataaataattctagaatctggtagtataacaggtgactatggtcaataataacttattgtatatttcaaaacaactaaaagactgaaattggaatgttcctaacacaaagaaatgataaatacttaagtagatggataccccaattaccctgattttattgttacacattgtatgcctgtatcaaaacattacatgtgccccataaatgtatacacctattatacaccaatgatcattaaaaaataaaaaaaaatcaaggtgataaacctaatccttctgaaactcatttggaaggaatgaaagatcaaggaccccaaggttgtgagtacgtacagaagcagtatagtaattggtaggtatgtactgctgcattttccctatgcagtcagtgatacctattggatatctacaaagcatctgtcacaagagacgacagaggagaagtttaacatacttctttaaagaacttcattctggctaggcgcagcggctcgtgcctgtaatcacagctctttggcaggccgaagtgggaggattgcttgaacccaggagttgaggctgcagtgagctatgattgcatgactgcactccagcctaggtggcagagtccctgtctcaaacaaataaacttcattccatttgcacagttaagacaaacacatgtgaagtagtatatatactcgggagctaagtggggcctaaaaaatgtaatttaatcctgtcaaccagcctgtaaggtagggatggctgtccccattatgctattgaggagacaaagcatagagagactaaactagttgcccatgtaacacagttcatgtgtaggagtgtcagggctatacccacattcatctgatcctgaagtccattcacagacccaccagagcttactgcttccaaatcaagaggacacaaacaagggccaaataaaccaggaaacattatatgaagcaatgggacttacgcctgaccttgaaaggcaagcaacagttggacaggcagaaactaaaagatatgacaccataagatgcaggaaagcatgcacaaaagcccaactgtgagatttagcttaatacaagaggactaggagagcagggaggtagtgactgattgatgggatgaagcacaaaaacaggaggaggtgggagcagaggtgacttgaaatcacatggggccagtggcaggtgtgaggagagtttgaacatggtgtgatgggcagtagagaaccatgggacttttaggagcatggaagtgatatcaaaaatcacaatttagtgcagtaattcttaaccacaggcaattttgctccccaggggcacatgtggcaatagctggagacacttatggttgtcacaacaggggaaagcatctagtggtcagaggccagggatgctgctaaacactgtacaatgcacagaacagcccccacaacaaagaattatccacacaaaatgacagtagtaacaaagttgagaaacctggctttaggaagatagtctggcagtggctgccaagatggaacagagagaagaagtcaagagcccaggggagatgttcattcggggagatgctcattcagggagatgggagtgagatgagggaccagaaggggagaatggcaaaccctccaagtatttcaaaggaaaaagaaagatgcaatttctaatccctcttacaggaagttttctacaaaatgtggaaaactgcacttaagactttttctttttttttttttttttttgtgatggagtttcgagcccaggctggggtgcaatggtgtgatctcagctcaccgcaacctcttcctcccaggttcaagcgattctcctgcctcagcctcccaagtagccgggattacagccatgcgccagcttgtccggctaattttgtatttttagtagagatggggtttctctgcgttggtcaggctggtctcaaactcctgaccacaggcccacctcggcctcccaaagtgctgagattacatgcgtgagtcaccatgcctggtcaagacttttttcttttaaatcatctgagggcaccttattttctgatctaaaaaattgtaaataatacacaactccaagaaaatcaccacctcgagagtgtagggcacaaacctttaactattatcagtaacattttctgtctttttgttagaacagaatctgaagcaaatttggcaaaatgttaacatctgttaaatttggatgatgggtacgtggttgtctgtaatattattttctatactttatagatacttgaaaattctcatgattaacaaaaaacagggtgggggaagaaagaaaaagaaagtcttagaggggcagttaataacttatactagaatttttcttggtattttaaaatatcatttgttaaattacagaagttatatgtgaatatgtgttcattgtaaaaaccattcaacaatacaaaaataaaaataaaaaatagaaattcccctttcattctatttctttttctctctccttaggttactactgctacatgttagtgtgtgtgtgtgtgtgtgtgtgtgtgtgtgtgtgtgtgtgtgtattgtgtatatatacacattatactacatatatatgtatatatagtataatacatatattatactatatatgcatatatagcataatacatatattatactatatgcatatatagtataatgtatatgtatatagtatatgtatatatactatacatactattgtatacatatatagtatatatactatatattgtgtgtatgtgatatatatactatatacattaatgtatattatatattatatgtattatactataaacattaatgtatattatatattatatgtattatactataaacatagtataatacatgtattatagtatataatacatgtatatacatagtataaacatgtattatagtatataatacatgtatatacatagtataaacatgtattatagtatataatacatgtatacacatagtataacacatgtattatagtatataatacatgtattatacatagtataatacgtgtattacagtatataatacatgtatacacatagtataatacgtgtattgtagtatataatacatgtatacacatagtatatacgtgtattgtagtatataatacatgtatacacatagtacatacgtgtattgtagtatataatacatgtatacacatagtatatacgtgtattgtagtatataatacatgtatacacatagtatatacgtgtattgtagtatataatacatgtatacacatagtatatacgtgtattgtagtatataatacatgtatacacatagtataaacgtgtattatagtatataatacatgtattatacatagtataacacatgtattatagcatataatacatgtattatacatagtataacacatgtattatagtatataatacatgtgttatacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattttatagtatataatacatgtatacacatagtatgacacatgtattttatagtatataatacatgtatacacatagtataatacatgtattatagtatataatacctgtatacacatagtataatacatgtattttatagtatatcatacatgtatacacatagcatatacgtgtattgtagtatataatacacgcatacacatagcatatacgtgtattatagtatataatacacgtatacacgtagtatatacgtgtattgtagtatataatacacgtatacacgtagtatatacgtgtattgtagtatataatacacgtatacacgtagtatatacgtgtattgtagtatataatacacgtatacacgtagcatattacatgtattatagtatataatacaagtatacacatagcatattacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataataaatgtattatgtacataatacacgtatgcacgtagcataatacatgtattatgtacataatacacgtatgcacgtagcataatacatgtattatgtacataatacacgtatacacgtagtataatacatgtattatagtatattatacatagtataatacatgtattatagtatattatacatagtataatacatgtattatagtatattatacataatataatacatgtattatagtatattatacatagtataatacatagtataatacatgtactatatatatacatgtatagtataatacatgtattatactatatatagtatatattacatatattatactatatatgtatatacagtacacatatacagtataatacatatattatactatatgaagtatatatagtatacatagtataatacatgtattatagtgtacatatatacatatatactatgaacatatatgtatatataatacataatacatatatactatatatgttatatatacacactaacatatatatactaacattagtatattactagtatattaccattagatatatactaatattagtataacattagtgtgtgtgtttatatgtatacacacacattcactaacagtgtgtatacatatgtggtgtgtatatacacacacacactaacattagtgattgtgtatatatattgatatgattcgtctctgtgtccccaccctaaatttcatctagaattgtaatcccaacatgtcgagggagggacctggtgggaggtgactggatcatgggggtggttttccccatgctgttctcatgatagtgagggagttctcatcagatctgatgatttgaaagtggcagtttcccctgcacactctctctcctgccaccatgtaagacatgccttgtttccccttctccttctgccatgattataagtttcttgaggcctccccaaccatgtggaactgtgagtcaattaaacctctttcctttgtaaattactcagtcaggtatactttatagcaatatgaaaatggaacacataaatatagtcacatggaataatatcttatatatgtgtgtgtgtaaatacatatatatgcccctaattattttcctacgcattcgtagaaaggaaagaagggaggaaaggggagaaagggaagaagggagggaagaagagagaaaaagagatttatgagatatctagatagatatctagatagctatctacctatccatctatcttatgagggaccacaacacacaggcaacatgattttcacattaacacattttagagggttgctcttccgtgtcaatttataaagatctacctctttctttttacttcttcagaatatttcatagtgtaaatgtaccataatttgtttactactaagattgctatatatttaggttgattccaatgttttgctatttcaaacaatcctggaacatacaactttgtgttcgtatataagaatttttgtaggggagattcctagaaatacaatttttggatcaaagggtatatacatttctggtgttgatatacagtaagattgtgcccccctgcaaaaaaaccgtgggctcctcatttctctaaaccctcactgatgctgtatgcaatcaacctttaaacatttttccacaattaccaaaactgcatccaaaaactactccacagacatattcacacttatgggaagtcatgaatgtacactgcactgttaatggaaaaatactgaaaaaatatttcaccaatagggaaacatttggacagattgttgtatatctgcacaatgaagttctgtgcatctattaacaaaatagcaaggactcactgtatatatccataggggaagctcttgaaggtagaggaacaaagcaggatgcagagcaatttatacagtgcataaccactagtgtttaaagtggtggtagtaaatatacatgttttactgtatgtacattaaagacagtgtctgggaaattacacaagatattgataacggattgcattgagggaaaaggcacaagagatctgggagaaagaggtggaaagggaactttccacatacattttttatacctattttcatctttatcgttgaaccctttaaatgtactacctattcaaataatttttacagtttgaattcagacattaaaaatctgccaaatggtagatgatgagtgctctcactgctgtttcagagtgcagtttcctaattgctggtgacattgaacttgtttttatgtttattggccatccactccctactcagatgtctttcgcattttgcaactgacttgttgctttctttccagattgctttttagggtttgttttttttttaatatatcaatgcttttttttacagttttattgaggtagattttacataccataaaagtcaaccacataagtgtgccatccagtgatttgtagcaaatgtatagagttgtacaatcatcaccatatatcaagaatattaagccattggttccagagctccttgatgcctcttgattacataatcctttgcagcttagctagaggaaatagttttcccccactgtaacatctgtcttttagtttagactccgatatggacagatgaaaattaatccacctagagaggcttgaacatagacaaaagtgaccaaatacaaggggcaaatgcaagtctcctactgagtctcaagaagaaaaaagaaggtttcactatgcaaacagaccatatgaaatattatttgacagtgtggctaatttcattcataaaaactaaatatgaactgtgggtgtctgagaatatgtagaattcaagaccagcctggccaacatggtaaaacccccatctctacaaaaaatacaaaaaaattagccaggtgtggtggcacccacctgtagtcccagctactagggaagctgaggtggcaggatcaccacctgagcccgggaggttgaggctgtggtgagctgagatggtgccattgcactctagcctgggtgaaagagggagaccctggaaagaaaagaaggaaggaaagaaggaaggagtgaaggaaggaaggaaggaaggaaggaaggaaggaaggaaggaaggaaaagagagaaagaagaaagaaagaaagaaagaaagaaagaaagaaagaaagaaagaaagaaagaaagaaagaaagaaagaaaaagaaatgtgggagggagggaaggaaggaaggaaaagagagagaagaaagaaagaaagaaagaaagagaaaagaaagaaaggtggtagggagggaaggaaggaaggaaggaaaagagagagagaagaaagaaagaaagaaagaaaagaaagaaaggtgggagggagggaaggaaggaaggaagagaaagaaagaaagaaaaagaaagaaagaagaaaagaaaagaaagaactatcagagagcttggagttgggagaagaataataaaacaaaacccatattcctaggttgctaagacttgcacccagatctgtcagcctacagagtccaatgtcataaccatggaactctactgcctcccaagcctgaaagtgctataaaatgactcttgaaattttaaaatctcatatttctatgtagctttcttttcccagatgtgcatgcacaccatttctcttaccaatcagcagtgtgtgtgtgagtgcttgtgtgtgtgtgtgcacctgtatgttttctttttactttctccatgataaatttttccaggttgtctcaataattcaatacacaaatgtcctattctacattttagatattcctgtatccaaatgtattttttataaagcagcttttacctccataggcccaactggaaattttttacattttaaaaccgtaggcaaatgataaacatttcacttgcttcccaactttctctcccatgtggaaacagaagcggatatgtagactgctttcctacatccaagtaaataaagataaaatctctttggaaacgtaccattttgataatgatcttttcctacccaaatttccatatttgaaattctaaagggatctagaaaaacagttccacccaataaacaatgtttgcatagttctctttgctagaactcctttggagataactctggagataagtgtaagtataaattggatttaaaaagcaactgccatgtaaagaaatctgtttctaagagcaactgaaattacaagagtcatgtgaaagagtgctgagaacgccatctttccctaagcccagagtttgtctcttttctgagttatgtatctgttattttgatgcaatttcttctgatctatatgttgtgctactaaggcagctgaagaggtgacaaagtttatttgaactaggcagtggaagcatcaacagacagcttggatcaagtcagaggacacatacgagtagattcaaaagacagtggtaatttagcttaactctagattatctcttacattgaattgccagtgccaactattgcatgggagttatattgctttctttaaatattcataaagccagcaatagctgacactcatggatcttctaaagtagaaaggttcccaaaagaatgtttaaaatataaacttgttaagaaacaaatctaaaggaaaatgtccaaagatatccagcaatttacacttctatgggaaaatggctatcgctggagttgttctctgcgccaggccctttttatatatacttgttatcgtctgcagagcaagtattagtatccatatttagagaggagaaagcagtcccaggaagaaaggctgagttatccaaaggcacacagctgatgacaatcgtgtttatctggtaccaatccctgggctattttttactctactaggcttattaactttctttccagaagactccttctccggaacacttctcagtgacttcttggacttcacaattttgtgttgatttacatcttcatctttctaacaaggaatcagattccctcaataatttcatttcaggctatttgtcatcaagctaacaacaaatgactccctcaggatggagttatgttgatgtgtctactaatcactcccctggtttgcagatcttggttgcattcagtctctggtcacagaagaggcactttcgatctcatatgatagtttgtggagcagggatagaaattatgaaggacatgttctatcctcctgcctctgtcagccaagaagaccttgatcatctgtcatgcatggtaacgttctctacagacctcaggcttggcctcagaatccttctcaatctaacaccccacacaaaccaatccattaaaattgacaagtgagatgaaattcaattgctatcacctatacaggaaaaccttctttatgcctaccagatacagaaacctttcttaattagtaaagtgtcccaaaataataacttccaagtatacagagctagaattcaaattatcttatgaagtcaaaatttaacccataatcaagaagaatttgtaattaaatcagagagctgactaaataggcattaaagtttactttaaatataaccaaagaggcacctagggctatatctcaaaaaaaaaaaaaaaaaaaaaaaaggcagaggtatctggaaacccaaattctttgtctgcttttattgggccttgggtctttagtatatcaaatgcaactcagaatcacccaattaatcaaaggagctgttaaaaatcatctgattatcggccgggcacggtggctcatgcctgtaatcccagcactttgggaggccaaggtgggcggatcacaaggtcaggagttcaagaccagcctgaccaacgtggtgaaaccccgtctctactaaaaatacaaaaattagctgggcacggtggcggacacctgtaatcccagctcctcaggaggctgaggcaggataatcgcttaaacccaggaggtggaggttgcagtgagccaagatcacgccattgcactccagcctgggagacagagtgagactccatctcaaaaaaaaaaaaaaaatcatctgcttatctacagggaacttaaacaaatttacaagaaaaaaaaaacaaacatcaaaaagtgggtactttttgaacagactataaacagacacttctgttcatagtctatgaacagacacttctcaaaagaagacatttatgcggccaacaaacatatgaaaaaaagctcatcatcactggttattagagaaatgcaaatcaaaaccacaatgagataccatctcatgccagttagaatggggatcattaaaaagtctggaaacaacagatggctggcgaggatgtggagaaataagaacgcttttacactgttggtgggagtgtcaattagttcaaccattgtggaagacagtgtggcgattcctcaaggatctagaaccagaaataccatttgacccatgaatcccattactggatatatacccaaaggatttataaatcattctactataaagacacatgcacacatatggcaatagcaaagacttggaaccaacccaaatgcccatcaatgagagactggataaagaaagtgtggcacataaacagcatggaataatatgcagccataaaaaagaatgagttcatgtcctttgcggggacatggatgaagctggaaaccatcatcctcagcaaactaacacaggaacagaaaaccaaacaccgcatgttctcactcataagtgggaactgaacaatgagaacacatggatacagggaggggaacatcacacaccaggggcctgtcgggggtaaggggagggagagcattagggcaaatacctaatgcatgtggggcttaaaacctacatgacatgttgatagatgcagcaaaccaccataggcacatgtatacctatgtgacaaacctgcatattcagcacatatatcccagaattaaagtaaaaattttttttaattgtctgattataaatccagggagatcaaattttctcttctcttgttcaaagccctttttatttttattcattcatgtaacaaaagcttactgagtgccagccctctgccagccacagtgcttgatgctgaggttgccggcaatgaccgtggcagagggtatctctgccctcactgagtgctcagcttagctgtcttcattcatgcatgcatccccgggcagtagcctcctgctggaagctcagccgtggcctaaggggagaggcccctaaacctccagtctcttgctgtagctgctgctccagacagctccgaacggttcctcatacctctttttttaaccacgtggtgcatttaacagccaacctgataaatctaaaggaaaaaagtcccaagcacaaatatgatttttcaagtgttgggaaaagccacattatttcatggagaactccactgtaattccttgaaagctttagttactctaaattgagtgtagcagacacatacttaaatgtttggaaagttttaccttacttaatttctctaatttttttaaagagaaagaaacaagattaagggaaatgggagtatgtgttaaagggtgggaagaagttagagaagtaaatactgagtatttattcccacaagtgaaatgtgaatttttcctttgagctcctcagtggactttggcatagttttgtgacttaggtatttaaaatatttgaatatttaagctatagggtttattgtaaatgaacataacactagaatatgatccctactacactatatactctctataggcagggattgtatccatcctcagcacccaacataatgcctggtgcagaggaggcacttgataaatatttaaggagtcaataaataagcaaacaactgatcgggagactatagaattataattactagatgatgctactttctatatttagcattttccttttacctgtgcatttgatttaagattgcactgctccagtgctttctctatcaatttcaatgtacataaaattttctctggacattacttggcttaggtgatttccttcctggcattttcatgctttgatctggaaaaaaaacttgtctgcagctttgaaggatactataaacctgaaaatacattttaaaatattggttttacatttcaggtctgcaataaataaaagactgatttacaaaatgtagtctaatcttgaagaatatgatggaacaagaaaacttgactaaacccagggctccaatcctaaaggcagatggattccagccacccttctcctaacacgctggccttcagagaaaaaactatggaggcaggaattgtatcaaaatcctcagcctgcacagcctcctgggaagaaggggactgttatggacagaatgttttgtcttgctccgaaattcatatgttgaaatcctaacacacaatgtgatggtatttggaggtagagcctttgggaggtaattgggtcatgagggtgaaatcctcataaatgggattagtgagtgcccttataagaagaaaccagaaagctaactagctctttatctgccatttcatgagaaatgggaagtttacaatccagaagagggccctcagcagaacccaactatgctggcatcctgatctcaaacttccagcctccagaactgtggactatttctgttgtttataagccaccagtctatcgtactttgttatagcagcccaaactgattaagacggggaacaaatggacatctgctggttttgcctgctgagaattcttgctctgttagttaaaagcatcctgactttcctttggatatacagaaaccactgaaagcagttttggtggactgtcaatcatagccctacctagtccagagataaacacatgcaataagcaagaccaataaatgttttcttctaagaatctgaatcatgaactgtaaaacacaaggacagaaaaagattacaacataatcattccaacagtgttcttagtttctgattcctatatttcaggacctgtgtagattcttatcctttgagctacctcatatctttcctttaaatccttgttttgattttgtttttgtgttttatttagattgaccagaatcggttgtttctgctgctcacaaccaaaaaatcctgttcatgctgaaactaaggttccgactactttgaagttgaaagttatcgaaaattatctggtgacttgaggttaagatagagcatggtaagacctactttaaacccaatggcacaatttaaaaaaatagaacatggaagtaacaaaaaaagaagacattttcttatgtgatgagagcaggcgtttcagacctgccatggccccactctgagcccattgatgagctcagggattagggttctttctaccccagattgcttactccacacaaaatgctaggatctccactttagcaggtacttctatggaatgcagaggccatttggaagctatgtcctctcagtgggctctgcatgtgtgtcctttgcattgagtacttgctgattcagtgttataatgaggaaaagaccattttaaaccaagtccaagtcatcttttactccaggatccaagttcagtccactttttgtggcctggcccagcccagggatggctgtaatcaaggtcatagagatgggaagaagggacaaggaggctcccaagagggaatattgtgtggctgggaaggaccatgagtactgacctgtgtaccaggagtcagttggatggaaacttttaaaatagacccagtaggcagctaaatcagaacctgcctcatgcatctctgcttcttagtggtaaacatcaacccacaggaactgacagtatgcaaaaaactaatgagttataaccctcaggcccaccagtccagcaaagagccctgttccttaagtgtaactcggagtgaagatgtgcaccccctggaggggccattgaggcctattttggggttggctgcagcaacagcagcaacaaaagccaccagggcaggcagatcggcccaagccacatctctttcaactacagattaactttccaagtgctggttttgccagcagcagcagcatgaatgagagatcatgaaaagcaggcatatgtggccacttgggtgtcttttcaaatgcacaggttttattaggagatggtgccaggtctctagatctgacaggagcagcaaattctggagcaggcagcatcctggacaatggttgagagtcctcaagcctccaagagacacacataaattgtacacctgagatgagagctctcagaaccaaccctgaagatctggcagctattaagaaaagaaatcctagacagaggaaaaggagtaacagcagacttgaggggaagataaccagtttgtttggtgcactgctgagtttgctgtgtgacgtagaatatatatccctgccaaatctcatgctgaattgtaattcccaatgttgaaggtgggcctggtgggagatgtttgggttataggggtggaaccctcatggcttggtgctgtcctcacaatagtgagtgagtccacacaagatctggttgtttaagtgtgtggcacctcctccccactctctgctcttgctttcgccatgtgatgtgcctgctctggctcctgctttgccttcaccatgagtaaaagctctctgaggcctccccagaagccgagcagatgctagtgccatgcttgtacagcctgcagaaacataagccaattaaatctcttttctttataaattatccagtctcaggtattcctttatagcaatgcaagaatggcctaatgcagaaaattggtaccagggagtaggcattgctataaagatacctgaaaatgtggaagcaactttggaactgggtaatgggaagagtttggatggctcagaagaagacaggaagacaagggaaagtttggaatttttaatagcctggttaaaatcctgatagtgatatggacaataaagtccaggcttacgaggtctcaaatggaaatgaggaattttattgggagctaaagcaaaggtcacccattttatgcttcagccaagaacctggctgcgttctgtttatgccctagggttctatgaaagtttgagcttcagagtgatggttttggatatctggcagaagaaatttctaagtagcaaagcatttgagaagtggcatggcttcttttaataacctatgctcagatttgatagcaaataaatgacttaaagtgggaatttatatttaaagggaaagcagagcataaaatttggaaaatttgcagcctggccatgtggcagagaaagaaaaagctttttcaggagagaaagtcaagcaggctgtagagcaatcatttgctagagaaatttgcataactaaaaatgagccaagtgctaatagccaagacaatggaaaaaaggccttgaaggcatttcagagatctctgaggctgtctctgccattagaggcccttaggcctaggaagactgaatggttttatgggctaggtccccagccccactgccctgtgcagtctttgggacagtgctccctgtgtccctgggacaatgctccctacatccgggcactctggctccaactcagctcaaaggtccccagatacaacttggactcctgcttcaaagggtgcaagccataaaccttggtggcttccacatggcattaagcctgcaggtgcacagagtgcaatagagaagggggcttggcagcctctatctagatttcagaggatgtatgagaaagccaggggtggagtcctcacagagaacctccactagagcagaacagaggggaaatgtagggttgggtgcgccacacagagtccccactgggacactttctagtggagctgtgggaaaggggccaccatcctgcagatcccagaatggtagatccactggcagcttgcaccctgcacctggaaaagccactggcactcaacaatctgtgatggcagctgtgcagattgaaccctgcaaagccacagggatgaagctgcccaaggctggggagcccaacctttgcaccagtgtactctgaatgtgggatatgtagtcaaagaagattattttggagctttaagatttaatgactgccctgttggattttgaacttgcagggtcataggtagaaggaatgcatttccacatgagattttggacttgggacttttgattgagttgatgctggaacaagttaagattttggggggctgttgagaagccatgattgtattttgtaatgtaataaggacatgagatttgaggggccagggacagaattatatagtttgaatatatgtccctgccaaatctcatgttggattgccaatccccaatgttgaaagtagggcctggtgggaggtgtttgggtcataggagcagatcccttgtggcttggtgctgtccttgcaatagtgagttagttctcacaagatctggtattgttgcacctcccacaccttcactctctctttgctttcaccatgcgaagtgcctgctcctgcttcaccttctgctatgagtaaaagccctgaggcctccccagaagctgactagatgctggtaccatgtttgtacaacctgcagaaccatgagccaattaaatctctttttttaataaattgcccagtctctggtatttctttatagtagtgcaagaatggcctattacactgtgtctgcaggatataaaggcagaaatatctacttggtagttgtttctacttggttggagtccaagagaaatgtcaaagctgaagacatgggtataggtaggagtcaaagacatggaactggatggtgtgcaccacagaaaatgcatcaggagaggaaagtgaaaggttaaggaaacttgggtaattccaaaatttaaaaaattataacatgaagaagaaaagagaaggggtgatcaaagatcaggtttctaaatctcagcacaattgatatttgggcccgcataatcctttgtctcagagggctgtccttggcatttgtttagcaacagcactggcctctgctcactagaagcactctcctccctgttttgacaatcaaaaatgcctccagatactcccaaatgcctttgtgggtaaaattgtccctgatcgaaaaccattgatcaaagatctaagaggaaaacaggaaacaaagtgtgtcacagaagccaagggcttgaaaaatagttaacaatgttaaaatcctaagagatattgagtaaaacgagaaccaaaggaaccagtgtttgtccagaaagtcattggtgaaccaatcaaaagcagtttcagtggaacaattaaggaaggacaccagactggctgaatgtccatccaacaaataaacagtaaatgacattcaccagttaaaagggtatttggttgaactaggtgatcattttaaggttccttccaaccctgaaattgtgtcattccaaatggtctccaaggaagatctttcaggatccctcaagccctgggctgctggtggctgctcacaagttgacatgtcaaactagcatgtctctgcttgccttactcaggtcacaggaaataaaaatccaaggggaattgctatgcgatccggacccaatccatgataaaaactaaaatatggttttctttatgtcatcacataaccaactgttaagcaatagaatgtgttagactttaaaggcagttgcgatttacagagaggctgagttcataagtaaagtccaggtttaaggttggtctgaggagaaagggccatggggctgaagttgcccagggtctgctggaagtatgtgagcattgtcaagtgtattagtccattttcacactactataaagatactacccaagactgggtaatttataaaggagagaggtttcattgactcacagttctgcgtggctggcgaggcctcaggaaatttacagtcgtggaaggcaaagaaacagcaagcaccttcttcacaaggcagcaagaaagagagaagagagagtgaagggggaagagacccttataaaaccacctgatcccatgagaactaactactatcatgagaacagcatgagggaaaccacctctgtgatccagtcaccccccaccatgtccctccctcaacatctaggggttacaactggagatgagacttgggtggggacacagagccaaatcataacatccaacacctctagacttgatcctgtgggctggatcagatgaggagagtcctgtctgcagatcaaacccacagtggctggagtgcactaactgtgccatggaatgcctgcatagtaattgaccttcacaattgcagcactcttctcaggcttttgaacaatcaaactaacttctatatgagtaaaaaagaaattaaaagcaaagatcagattttcaaactaattcagaaagaaaggatagcagagattctgtttttaaaatgctgaattgaaggctgggcatggtggctgacatctataatcccaccacttctgggaggatcacttgaggcctggagtttgagaccaacctgggaaacatggcgagacctcatctctacaaaaaaattagctgggtgtggtggcatgtgcttgtagtcccagctacttaggaggctgaggcaggaggatcgactgagcccaggagatcaaggctgtgatgatccgagatggcaccgcactatactccagcctgggcaatagagtgaggccctgactcaaaaaaataaaaataaaaaaataaaaaaaaagcaaaattgagaaacaagaattttattcctggcttagttactaacaaagggtgagtcacctcccttctctgcattcagtttccacacctgaaaaataggggtttgagccaagatgctttttgtttctgaagtagagtcgggggttcctgatgtgtgtttccactgttgaagttcttattacacttcatagtatggcttgtttaattgaatgtcctccaattaacaagtgtagtgacctgttccaccacagtcactacaattcacttgtccaccactgaatcccctgcagcctgcagtccttgacaaatatctgttgaaggaatcgatactcctacctacaaaaggcagctctagggaaaaagttatttggtataaatttcaataccatgagctaggatcagagcctcccatcacactttgcttctttaagtttttataaaagctcagctatgggctacagtaagtggcaacattctaaaatacttcccacacctctgatatggatatcactaccatcctatcttatgacttccaactaaagcaaaattggaagctgcatcccaagtcaactattttaaaagacaaaaaatccaacactgttaattctggtacgttactcacctgccccaatgaggttaacttgccttgggacaccagaaaacgacgcacaagatttaatgggtaaggaatcttactttggagtgacaggaatgttttataaccagatagaggtgatggttgcacaatattggggctgtaattaatgccactgaattgttcccttaaaactgtttaattttatgttatgtgattttcacctcaataaattattaaaaataagaaatatagcacctaaaatatatttttatgtgaatttgctgtttcaaaaaacccactttattaaacatttacttgaatacaaaaatgaattccaaattaaataattccttctggagaaaggcccagaaaaagaatatagagctgcttataactcattgttaatttgcaaatgatgctgaacccttgccatgcttctgcataatgtggttcagtcaagggtttggtaatgagcagttcatttggagccatttttccagaataaaggatgctattcatgaaatgattcctcaagtatttatagttatatgccaatctttattttttagtttatggggagacttctttttgaaaggcttaatttgggacttaagaaatttaaggggcctcaggttgcttctcattgataactgatcattccttctccccatattcaatgtgtttgagtggtgtagtagttttctaaggctgccataacaaaatgctaaagactgggtggtttaaacaacagaaattaattttctcatagtctggagactagaagtccaatatcaaggtgtcggcagatttggtttcccctgaggcctctcttcttggcttgcagatgagcacctttttgctgtgtcttcacatggcctttctcctctgtgctcatcctaattcttcttgtgtccaaatttcctcttcttataaggacgccagtcaggttagattagggcccacctaatggccaaggttaggggttacagcttcaacatataaattttgaagaaacacagttcagcacataacaagcagtatctaaatggacccaccacatattacaaaagtttctaataataatgcaatattaaagtagattcaacctcaacattggcaaagacaagcagcttcatgatgcttttcccgttttgcttctccagccaagaggagaaaaaaagaaatattttaaatagcataaatctgcttttgttttccaagggtctatttttttcttttcctaggcaagtcctagttataaataaaataatcctaatcaagttatcgataattttaatatccttttaattaagtacatgaggtattaaatataaatttaactaaatctgattcccattgggaaatgaatgactactctgaggtgattcacatttgtaaaatggcaatgatactcatctatgtcactggaaacacataaaaataatatacatcaacattgattgtaatctatgaaatgcaacattaatacaaggtgaaattattaataatgccattcagtacaaacaaatgaagaatgatgcaattatataagaaataaatttgtgacagaaaatttctcagttaatttttatgtaagctttgcttttttggcttagttttatttcaagaattattgaatgagtttagaaagagtagtgagttgtaggtatacgccattaagcaagttgctcctttcgttagctaagaaaagaatctggaggtggggggttaggaaggaaagaagctcaaccagattctaatctcgtttttccttctatgtacagatttttttttttttgcatgaatttgcttgaactcaatcagcactccttttgtgaaagaaatgagcggaataaaggggatttgagaattgggcaagtgcctatggcaacacaacattctaaggactgacagtgcacatcaatctgtgctatctgatggcaaatgagagaagctggatgcatgactggagaaaggtggcaatcagcttcaatttgtctgccgtaaataaggattcactttctttcaacagaagttcaaagcttttcatttttatctttcctatctgcataaatgcccaccaaagaaacattagacttagagaagatcctcacaattcgtaatcgctttctctttttctcttgttaggtacatgttgtgaaatcctggaagaaagctgagttgttaacaccaattactttaatcctgatttattattcagctttgcaaatgtcagtccccatatgtctctgcttctacacctaactttgaaggttatacataagataaagatacacatattacaattttcaatgagcaaataattccaatcttacacaaactcttccagagaataaaaaaggagaaataagtcccaagttattttataaacttaatataacctctacatcaaaacaacattaggaatatgtaagaaaagaaaattccaggccaatcaccctcatgcacaccaaaacaagaaccataaatacaatattgataagctaaattttacactacatatcatgaccaagatacagttatctaagaaatgtaaaactggtttaacattcgaaaaacatgttagtgtatttactgacatttctagattaaagaaggaaaaaaccaaatgaccaacccaataggtctggaaaaagtgcttgataaaattaacatgtacaataaaagttttcatccacttcacaatgaaagtgagtttccttaaccttcaaaagggtaactataaaatatctacagcaaatacccttcataatggtgaaatattgagcattcctgttaaaaacaagcagatattggggccaggtgcagtggctcacacctgtaatctcagcgctttgggaggtgtgaccagcctggccaagacggtgaaaccccgtctctactaaaaatacaaaaattagttgggcgcagtggcaggcacctgtaatcccagctgctagggaggctgaggcaggagaatcacttggacccagggcgctgaggttgcagtgagccaagatcgtgccactgcactccagcctgggtgacagagtgagactccgtctcaaaaaaaaaaaaaaaaaaaaaaaaaaaaacaagaagatacaagtcggcctacgatcaccacttctagtttacattatgttagagatcctggtcagcagagtaatatatgaaaaagaaattaaagatactaagattggacaggaaaaaaccacatttttaatttgaaaatgatatacctgcttacacagaaaaccaaaaagaatctattaacaaattactgaaattaatagttataaaatataacttataagtttaaaagcagatacaatagtaataaatagccaatattgtttttaaaagccatactgtttacagaagcaaaagcaactatacggacaccatttgcaaggctaaaaactgtgaggtacattaaaataaatctagcaagagattttcaagactttatgataaaaaaaaagaagactttatgacaaaaattataaaaattttattttttagatacagagcctcactctctcactcaggctggagtgcactggcacaatcagctcactgcagcctcgacctcctgacctccttggctcaagctatcctcctgcctcagcctcttgagtagctggggaccacaggcacgtgccaccatgcctggttaacttttttttgaatttttttgtagagacaaggtctctctatgttgcctgacctgatcttgaactcctggcctccagtgattctcctgcctcagcctcccaaaattctgggattacaggtgtcagccaccatgcctgaccaattaaaaaaatgaaaaaccttattaataatcaggaaaggccaggtgcagtggctcacgcctgtaatcccagcactttggtaggccgaggagggtgaatcacctgaggtcaggagttcaagaccagccttaccaacatggtgaaaccctgtctctactaaaaatataaaaatgaactgggcgtggtggcaggcacctgtaatcccagctactcaggaggctgaggcaggagaatcacttgtacccgagagacagaggttgcagtgagccgagattgcaccatttcactccagcctggacgacagagcgagactcagtctcaaaacaaaccaacaaacaaaacacacacacacacacataataatcaggaaaatgccagttaaagccaatgagataccattacatatcttccagatgggcaagaattacagatctgaagcagaacattttggtgaggatttgaaacaacagaaatgcttttacagtgctcatgggagtgtaattacaaactatttaaaaagtgatttggccctatccggtaaaggtaaggatacatataccctatgagcaggaaatagatatgaaattatttacagcagcatcatttataagaaataaaatgaaaactgccgtgcgcagtggctcacacctgtaatcccagcacttcgagaggccgaggcgggcagatcacgaggtcaggagatcgagaccgtcctggctaacacggtgaaaccccatctctattaaaaatacaaaaaaattagccgggcctggtggcaggcgcctgtagtcccagctacttgggaggctgaggcaggagaacggtgtgaacccgggaggcggagcttgcagtgagccgagatcgagccactgcactccagcctgggcgacaaagcgagacgccgtctcaaaaaacaaacaaacgaacaaacaaacaaccaaagaaaatgaaaactaacagactaaaaaaaccacataaattggccgggtgtggtggctcacgcctctaatcccagctctttgggaggccgaggcgggcggatcacgaggtcaggagctccagaccagccttaccaacatggtgaaaccccgtctctactaaaaacacaaaaattagccgggcgtggtggcgtgcctgtaatcccagctactcaggaggctgaggcaggagaatcgcttgaacccgggaggcggcggttgcagtgagccgacgtcgtgccactgcactccagcctgggagacagagctagattccatctcaaaaaataaaaaaggcaaacaaacgaacaaaaattaataggtaaatggatgtaagtacagcatgttgttataagcactatacagcagtaaaagaacgaactactgctcaaacatcaacttggttgaatctcagaaaccatgtcattgagtgaaaaaagcaaggtacagacgatttcttagaatacgaatccatttatacaaaattcaagagcaaatcaaatactgctaaagatactgaattagttttctagggctgccataacaaaacggattaagcaacacaattttattttctcataaatctggaggctcaaaatttgaatcagcaggcttgatttcttctgaggcttcttttcttggcttataggtggttctcttctctaaatgtcttcacatggtcttccctctgtacacattctgtgtccaaatttcctcttcttaaaaggacaccagtcatattagatcaaggaccacccatgtgacctcattttaacagaattatctcttcaacaaccatatttccaaatacagtcacattctgagatactggaggttaggactccaacatatgaatttggcacaggaacacaattcagcccataacggacgcatgcatatcagtaaaactataatgaaagccaaaaaaaataaaaagaaaagaaaaagaaatttccctatgtagctaatccagaaaagatacacagagtaaaatcctgaacatgtgttaattgtgaaagttccatattagctcatctaattaggaaatgagtgctttaccataatttgacaacacattttaaaatgtgtttgtttcttttgtaaaacatctataacctgaaaaaaagtaattatagatgactagatgataaaatgtttactcttgaattcgcgattcaatctcaaaaatgaatagtatcaaattcttctacttagaaaaaaattaatgtatcaagaaaagagaaataaggacattcatatgataaaatgagacgactttagcttatttctacaatagtaaacccagatgggctcatgcaaacttgaaaaacgatatcctctccactttcctactttacaagctaatggtgtttatacttatagaaaggaacaatagaggaggtgacagttacaaagtgctctcattgtcaatggaaacattatccaagaagatttgaataaagcatctagaaggataaattggattgtttttctcccctttggaactcttgtggatacagtattttgcactctggcacaagaaggaaataaatcttagaaagtaattacaatacattcagcagacatttatacatagcacttaccaagggactcaattaactgagcacctacaatgtgccagggactacatgtgaagccacagcatataaaacttctacatttttctcctgttcaattgaatttaattaggtcaaaaacttctatatagagactgaaagcagatcactggttgcctggggcttagggtaaaagtgtggattggatgtcatttacttttgagattgaatttttgagattgattagcttgcctgttcaacaagcattttatactctagtcatttacacataattactctttttttcaggtgatagttgttccaaaaagaaaaacacttaaatgtagaggaaaatttctgtgataataataatgttctaaaactagatggtggtgaatggtaatgacaaatgacttttcaaaaggattttctccaaatcctatgaattaaaaaatatggcccaatatgatatttaaactttgtactaatactaataattcttgtgtatatcaactttacataaaataggtatttgtgcatgagaagtttttctaaaaaacaattacaaaatttgaccttttttttttttttttttttttttttttgagacagagtctcgctctgtcttccaggctggagtgcagtggcgtgatcttggctcactgcaacctccacctccctggttcaaatgattctcctgcctcacctcccgagtacctgggatcacaggtgcataccatcacaccgggctaatttttgtatttttagcagagacagggttttgccatgtcggccaggctggtctcaaactcctgacttcaagtgatctgccagcctcggattcccaaagtgctaggattacaggtgtgagccactgcaaccagcctgacctgtactttcttgactattttatgtaacagttagtaatatattgctagaatttttaaagctcaagtgaaattgttacatctatgataaacatttaattatatttagtaggcaaattttaaggagtcatatctaattgatgattacagagatatgaaaacatctaccttggctcttaaagtttacacaaattccatataatgattccctacagaaaacagttcacctaaaataaaattcttaaatttgctttaaattatgttttttcttattatttgtcatataatgtgatcattattatattttagaaagctacagcttgataaaatttgatttaatttttactgcaagatttatattcaaccaagggtataacaggttccctccagccacagggccttggcgcatgctgtttgtcttgtttgccatgctcttcattcatccttcagatctcaattcagacatctctacctataggaagtatttccccaggcccctagtttagatcagattcctttattatacactctcttggaggcatttagttcctttagagcagttctttggtttgcaattatataatcattaagttagatgttgaactaagggcaatctcagaccaggtgcagtggctcatgctgtaatttcagcacaaggcaggaggatcacttgatgccaggagttcaagaccagtctagacagcatagtgagattctgtctttacaaaaaaaaattttttttgagataagatctcactttgttgcctaggctggagtgcagtggcaggatcaaagctcactgtagcctcaaccccctcggctcaagatatcctcctgcctctgagtcccaagtagttgggactataggcacatgccaccatgcccggctaatttttgtattctttgtagacctggggttttgccatgttgcccaggctagttttgaactcctgatctcaggccatctgcacacctcagcttcccgaagtgctgggattacaggcatgagccaccgtgcccagcttctataattttttttttttaattagccaagtgcggtggtgcatgccaatagtcctagctcctcaggaggctgaggtgggagaggaccacttgagcccaggagtttgaggttgcaagagctatgattgtgccactgcactccagcctgggcgacagagtgagactcttttaaaaaaaaaaaaaaaaaaaaaaaagtcaatctcccacaatccaaccctccagaggagcagactctgcgtctggtttggcacattattacttatatctctttcttctaacagagcgcctggaacatagcagatacataaaatattcactgaaaaaggaaagaaggaaaagaaaaacaacacactagatggttttcctggaatcatccctttcccagtcctgccaactttactgaagactgaatgctgggtacaaatgtcacaaactcagaaagcaaactaattatgaccacatgccttgaatctggccaattagacctgtcttctcccaagaatttgaatcttaaggggttacttaggctgaaaggggcagatgagaccatcatctcaatggcatgggcccctgagaagatgactgtcagcttttgtgctattgggtcctggacagccactgagacttggttcttcaactttccttaaattctgtaagctactccaaaattttttatttttgcttaaattagccagagttagtttctttggcccacagccaaagaactccaactgttatattttcctatctcttttaccttaatcagatgtaaagatttctatatgcagtatttctcaagactagagatgaatgctatgaatttcagaattgtaactaaaggactgtgctacatttaaccaacacaaatgcttacagtaaatggttgcttcaaaatgctgttttgcattggctcaggccaagcccttctccgactgcccttctagttcatttctagcacatcttttccaaatcctccttcattctctgtctccaagctgtgatgtgtagttctttctacgccaaagaatctttctcaaaattcaatcagctttgttaagtcccatatggaaaactccagtcccatgaacttcttatttatcttgagcttacctacctccatccatcctccctccttcagaccaggcaacctggcacttgtgtgtctcttacggtcttaccttccgggtggttacagctagcattcactgagccagggatggctccaaacactttacatgtgttacttcattaaaccctgacaacagccctaagtgatagagacttctattgcagatcagggcagtgaggctcagagaaggtaactaacttgagtaaggacaggaaaaaatatttgacctggacaacttgactcctgagcaggtacccttaaacaccacgtttgtccgcctcagtgtttttcaaatttctcaatatttttcagatctcactcctctccacttccctccccgttaaaataaaagtctgtcttcatcttgcatcttcctgtggccttcttcccttcactttccagtcttcactgcctccactgtagtctagcttccagccttccagccttctgttctcactaaatctgcccttgctgagatcacaaagaggctccgccaagcaccaggtaccttacacattcaactgtgttgaattcatctactcattcaccaaatggttttgagcacctactctgttccagaaactgtgaaatatgaactgggtatatagtagcgaacaaaacagatggagtccctgccatcacatatctgagatcatcagtgacttcttaccttccaggtacaggagccactttggccacttctcatattttctcctgcttaatctctgcagcattggtcatgccaatcatttcttccttgaaatttggagctgctttggcttccgtgaagcctcttacccctgattctctatttctgggaccatgccttctcacttcctttgataagtttctctttttccatcaaccccttaaatgttggagtttctgagagttctatcatggagcacattaaagtcaatatgcctgaaacaatgttttttctacctcccatccacatctttccatctttattccttgttcttgtgaatggcagcatttgacacccaatctcccactctttttctgccccacgcccttacccaattgtcagaaaatcctcagagttctacctcaatataccccttacctgttaacgctctccttacctctccttggacaaatgcaatggaatctttttttttcttaacagcttcattgagatataattgttataaaatactgttaataccgttaagtatatttttcatctcagacactgtatttttcatctttagaagttcaatttgggtctttaaaatattttctatgtctctatttcactttttttttgagatggagttttgccctgttgcccaggctggaatgccatggcacaatctcagctcactgcaacctccaactccgagttcaagcgattctcctgtctcagactcctgagtagccgggactacaggtgcatgccaccacacccagctaattttgtatttttagtagagacaggatttcgccacgttggccaggctggtcgcaaactcctgacctcaagtcatccgcccacttcagcttcccgaagtgctgggattacaggtgtgaaccactgtgcccgcctctacttcacttttaaaacatttgcaatccagttataataactaatttaatatctttctctgctaattccatctgtgtacgttctcagtcagtttaaattgattgattattcttcttatactgggccataatttcctgcttctttgtagggtaatatttgattggatgacagaaatcacaaattttaccttgtttgggtacaaggtacactttttgtatccctgtaaattttcctgagtctgggatgaagttaaattacttggaaatagtttgatcctttcaggtctagcttttatgacttgttaggcagatctgcagcagtgttcagtctattccaatactgaggcaaaagcttcctgattaatctaccctggattttgggtttctccagtctggctgatgggaggaggtattgttcctggacatgcctgagtaccagctactcttctctctaactcttctgagtggttacatccctggccttacacgcgtgctgcttagcactttgctgaatactgaaggagcgtctgcacatctccaggcttctctgcctttgtgcagctctctcctctgtggtgctctgttctaggaacttgtcttggtctccccaaactctcagcttggtctcctcactcagggagaccgctgggctccacctgggtttcctctccctgcatcagagtctggaaactctctcaaagcagtgcgtagggctgtaggatttgtctatccttcatgtttcctgtttcacaaggatctctgtcttttattgcctgatgtccagtgttttgaaaaccattgctttaggtatattgtttgtttttgttgtttttgttgggaagttaaatccagtcctgtacctccatcttgaccagaagaggaagtcttccaacggaatcctaaccaatcaatcaccttatctcaaacttttgcaatccagttttctcactttatcaaaattttattttttcttaaaatactaatctctttcaaaaaaccagctcctggattcattaattttttgaagggtttttttgtgtctctattcccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagatctggtatgttgtgtctttgttctcgttggtttcaaagaatatctttatttctgccttcatttcgttatgtacccagtagtcattcaggagcaggttgttcagtttccatgtagttgagcagttttgagtgagtttcttaatcctgagttctagtttgattgcactgtggtcggagagacagtttgttataatttctgttcttttacatttgctgaggagagctttacttccaactatgtggtcaattttggaataggtgtggtgtggtgctgaaaaaatgtatattctgttgatttggggtggagagctctgtagatgtctattaggcccgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggaaaaagggctaatatccagaatctacaatgaacacaaacaaatttacaagaaaaaaacaaacaaccccatcaaaaagtgggaaaagatatgaacagacacttctcaaaagaagacatttatgcagccaaaaagcacatgaaaaaatgctcaccgtcactggccatcagagaaatgcaaatcaaaaccacaatgagataccatctcacaccagttagaatggcgatcattaaaaagtcaagaaacaacaggtgctagagaggatgtggagaaataggaacacttttacactgttggtgggactgtaaactagttcaaccattgtggaagtcagtgtggcgattcctcagggatctagaactagaaataccattcgacccagccatcccattactgggtatatacccaaaggactataaatcatgctgctataaagacacatgcacacgtatgtttattgcggcactattcacagtaggaaagacttggaaccaagccaaatgtccaacaatgatagactggattaagaaaatgtggcacatatacaccatggaatactatgcagccataaaaaatgatgagttcatgtcttttgtagggacatggatgaaattggaaatcatcattctcagtaaactatcacaagaacaaaaaaccaaacactgcatattctcattcataggtgggaattgaacaatgagaacacatggacacaggaaggggaacatcacactctggggcctgttgtggggtggggggaggggggagggatagctttaggagatatacctaatgctaattgaagagttaatgggtgcagcacaccagcatggcacatgtatacatatgtaactaacctgcacattgtgcacatgtaccctaaaacttaaagtataataataataaaataaaataaaaagaaaaaaagaaatactaatctcttgttattcccttgcttcaaacttttttatggcacccccatatttttataataaaatttgaactgtaattttaaaaagaaaaaactggatttaacttcatctacggatgccaatttcatcaggaatatttaccttgtactgaccagataccatctaatagtgatattgaagttagacttcagagatagactttttttctttttttttttttttttgagacagagtcttgctctgtcacccaggctggaatgcagtggcacgatcttggctcactgcaacctctgccacccggtttcaagcaattctcctgcctcagcctcccaagtagctgggattacaggtgtgtgccatcatgcctggctaatttttgtatttttactagagacagggtttcagtatcttggccaggctggtcttgaactcctgacctcgtgatccacccgtctcagcctcccaaagtgctgggattacaggcgtgagccaccgcgcccagcccggtagactaatttgactctaccattactcaccgtctgacttaatcaaggtattttacttctctaagcctcagttttgtcttctgtaagatggagaaaatactaatatctacaacagagttttcatttgtttaagaatagtttgagacacttttaaaattcttagttctatgtcaaatataacaagtactcaataaacaggaacttatttcagtttattattactaaaacaatcaatcaattggttattttgttgtctgttcaagaatatcatgattacaatttttgtttctatccagtgaacctctgtagaaataaagttgggggctgggagtggtggctcgcctctgtaatcccaacactttgggaggccaaagcaagaagatcacttgagcccaagagtttgataccaacccaggaaacatagtgagacgctgtctctacaaaaaattagaaaattagcctggcatggtgacatatgcctgtagtcccagctacacaggaggctgagtaggaaggatcacttgatcctgggaggtcaaagctgcagtaagccatgatcatgccacttcatttcagcctgggtgacagggctagaccctatctcaaaaagaaagaaagaaagaaagttagataattcttgctgtgatctattttgttattttgtagtctaggaaaattaatgacactttcaaaaatagatgcattcccttccaacagtacaacataaaatacaaaattaaactgtcacaaaagtcttcccaaaagattgaaaattatatgatttaatacttttaagtatctttctaaagcggcgcattttcaaatatttctaacattgggagaaaagcccatctgctgaatcttctagttgaagcaaggagttttcagttctgttgagcctttcccagggaacgataggaaaggtgggtggacccgaagagaagatggctgtgtccccagtggggaaggagtaaacaaggcctgtcactaatttctgtggaaattcagagtcaataaagctgaacactggtgagcaaaatgagacagaagtggagtttcagaatgggaaagaggaaagaaagaaagaagaaacaatcagggcctaacaaggggcagcatatcggagacacatttttccaaaggctgggaaagaaggatgtctggtgacaggtgtttttccacattctgtagaagggcagagaaagagagagaatacatacaagaggagaataatgagattggcacctggaaatcctcaagaacaggcatctgtagtaatagtgtgaacacattttcacatttaactctccaaaaaccctaaatgccaaattctaatattatccccattttatggggaaagaaactgagacttagagaggccaatgaacttcccccggaccacacagcaaagttagcagcaagtcaggaatttgaatctgggtctatttaatcagagcctgcattcttctccaccttgctgtactactagctcttggtaatgcgaggaaagcaggagattcaaaggaatttaggaaagcagtgggggaatgtgaagaaaaggtactggcaaaacttcatacctctagttcttaagtaaaaatttatttaaatttttctttgtgtgtgttttttttttaagccttggcaaaaatgttatcttataccacagtaataaagcatgagattcttggccaggtgtggtggctcacacctataatcccagcactctgggaggccaaggtgggcagatcacctgaggccaggagtttgagaccagcctggccaacatggtgaaaccccgtctctactaaaaatacaaaaattagccagacatggtaacgcatgcccataatcccagctgctcaggggctgaggcatgagaatagcttgaacccaggaggcgaaggttgcagtgagccaagaccacatcactgcactccagcctgggcaacagagtgagactccatctcaaaaaaaaacaaagaaaagaaaagaaaagaaataaataaataaaatgtgaagattcttaagtaattttatgtaagggggcttatttgcaaaagtcaaacttcaagtactagtttatacaattactcaaatattgtgaaaatctctttggagatgatgattcctatttctgcttaagaattagctttagatttattaaggaagtattttttaataagcttaatataatcagaaaatgtgtctctaagtcttcaggaagagagtcatgattttctagaattttatattttctgtgttaaccatttaaaaccatgattattcaactaaaataaatctcatctgttaaaacgtccatatggtattgttgtatataaagctggacccacactgccatctgctgtgtcaagattaggtttaacatcacccacataaaccgggtttaagaaatgcaaaaaaattatattgaaaacccgtattactttgcttcttggaaaatgaatgcaggggaaaataagtactagcagttatttatttcaacttgtattagcagtgtggggagaaattgtatgtgtttgtgtgttttaacatgacatatttcagggacacaaaaatgaatagagaataatataacaaaatttatgtttccaccatctttactaaaaaatgaatattaccaatgccattgatacttgctgggtttgtctccctggtctcattgtcaccactcccacccaaggaaattaccctcatggttgtcatgtttatcactgggaaagcctttcacaggcaaatatgcacatctaataggtaaatgtgttcaccttttacttctgtgtgctttactaaggttgaccagtgaagaagtttctatgctagcaacttcaccctggaaaattagtggagagagctctattccaaaacagtcctgttattcccaggaggattttttcccaaatttaagattcagagatgcccagatgatctctccttggttgccgctaagtgattggtgttccctttctttggtatgtctatggtaatatgtaaattataagcccccattgtcacattacaggttcatgtggggagaaaagtattctacataaagggaaagctgaagaagagacacagaaatgagagaggatagtaagtatatttggggaagagtaagtagactgtcacagctggagcatcaggggatacgggacataaagatggatttctagggcctacaaaagccactgtgccattgacagaatgaagggaaatggaaccacaagagtcatgttgggaaaggacagtacaatgtagcattgcctctgctgcattcgaggtgattccacacagccatgcgagaactggcagctgcaacaggagactgcataggtgaggagagaagtagaaactgggagtttcagacccacccttacaatccctacagaaataagagttcaagggaggtaagagagaggttgagcagtcagaagtagggcctgggagaagagcaggggccatggatgctagaaaacaaaactggggagtcagtcatgagatgcagcagtatatccctctacaaacgatgaaaatgctcttactgcaattctccccagtatctgaccactctagctaactataacttaaacctctttcttttggtcttatcatgtaactgcccttctaataatgaacctgaatagagacaattccaggaggaaaaatattgagccagagacaccacaccatctgcaatccagttccccatctccttcaacacttttatgtaagaatgaactagtttaagtccagacacggtggctcacgcctgtaatcccagcactttgggaggccaaggtgggaggatcacctgaggtcaggagtttgaggccatcctggctaacacggtgaaaccccatctctactaaaaatacaaaaattagccaggcgtggtggtgggtgcctgtaatcccagctactcaggaggctgaggcaggagaatcacttgaacccaagaggttgcagtaaacagagatcatgccattgccctccagtctgggtgacaagagtgaaactccgtctcaaaaaaaaaataaactactttaaatgtatatcaggcaggctagaaagaaaacagaagatagcgccacagaggagcctgcaaggtctaggttaaaggaccccagagaaagccatctcagatggtattgctaaacagaaatcttagacatattggtgacagactgcatctttctgagtcgggtttctgtgcatgaggtggtatgtgtgtgtgggtggtgcaagaaatgggagacaaggaaagctggagaactccaagccattcaaaactcaaaagcaaatcccataatttgttcatctctatagatttcaattagagctacggtctcaactcttgttgggtactgtactggaaaggaggggtgcttcatggaacaagtacagtcatatgtcccttaatgatgggaatacattctgagaaatgccttttaggtgattttgtcattgtgtgaacatcatagagtgtacttacacaaacttagatgacacagcctgttgcacgcctaggctatcttgtatcactattgctctgaccaccaccgtatatgagggtcgtcgttgactgaaatgtggttatgtggcacatgactgtatatgcattagttgtattattactttaacaaattaccacaaatttagtggctcaaaacaacacaactttattatcttacggttctgtaagtcagaggtctgatgtgggactcaccgggctaaaattaaggtgttgccagggatgaatgtcttttggaggctctagaggagaatccatttccccgctttttccaattcctagaggccacccacagtccttaacttgtggctccccttctccatcttcaaagccaacaatgtagcatctctttgaccctgtttgcattgtcatacctctctctctgaacttctgtttccctctttcatttttaacgatccttgtaattacattgggcccacccaaattatctaggataatctccctattttaaggtgggttgattagcaatcctaaatccatctgcaaccttaattcccctttgccatgtaaggttacatattcacagttttcagggattaggatgtagaatttttggggacaccattattctgtttgctgcaaggtgcttccatgtacattgacctgtcataaacacaattaattggtggcacaattcattttcctcatagataaatgtgttcaccttttacttctgtgtgttttattaagactgaccagagaagtctccttgaaagcaacaattatcctggagagttcatgcagagttctattacaatacctttgctctcaagaagaatttccccaaatttaagagtcaggactgcccagctaacctctccttcattgctgctaagtcttataccaaccatagtgttctcttttctttgatatgtctaagttaatatataaattatgaacttctattgccacattacaggtttagaagtagcatgttcccattttacatgattccttttctagcaggcagttactggtttacggcaatttttatgtatcttctttccaacagatatttacttagagcttcccacgtgttaggctttgggggcaatacagagcaagggcagcatgtccctgctctcagagattatactctagtgggcattcagggacagtcacaaatgctctgtggagggaagtgcagagtacaccctggagtggaagaagggtctaacccagagacggagacagtaagggaggttcccaggaagatgtgacatctcagcaacaaccctgtagaacaagttgctcaggtgaggggcatcctgaggaacagcatttcagcaaacagaaatcactccaggagggcagggattttgtctattttggttatagctttatcccttttgctaaaaacaattctgcggacacattaggcactcaataaaatatgtggaacagatgactatgcaaaggtggaagataggaacaagtgtggctacatttgaggaaatgaaagctcagtgtgttaagagggcagtggtgagaggtgaaatttaaaaggttgaggccgggcacggtggctcatgcctgtaatcccagcgctttgggaggccgaggcgggcggatcacgagatcgggagatcgagaccatcctggctaacacggtgaaaccccgtctctactaaaaatacaaaaaaaaaaaattagctgggcatggcggcgggcgcctgtagtcccagctgctggggaggctgaggcaggagaatggcgtgaacccgggaggcagagcttgcagtgagccgagatcgcgccactgcactccagcctgggcgacagagcgagactccgtctcaaaaaaaaaagaaagaaatttaaaaggtcaagatgggactcatgagattgttaagcccttcgtgctttgtatcaggagcaatagggttttttaattattgggagttttttattttaatagactgttttataagagtgattttaggttcgctgcaaaattaacaggaaatacagagatttcccatatactttctgccccttccccaacctacctctttgtcaacatccccgactagagtagtacatttgttacaatggatgaatttatcaggacaaaccattcttgctcaaagttcatagcttccattagagtttgctcttgctcttgtgcattttacgggtttggatgaaaatgacatgtttattagtccgttttcatacggctataaagaactgcccaacactgggtaatttatcaaagaaagaggtttaattgactcatagttcagcatggctggggaggcctcaggaaacttacaatcacagtgggaggtgacagggaagcaaggtgccctcttcacaagacaacaggaaggaggagggctgagcaaagggggaagagctcctcataaaaccatcagatcttgtgagaactcattcactatcacaagaacagcatgtgggaaactgcccccatgattcaactacctccacctggtctctcccttcacacatgggggttatggggattatgagggtcacaattcaagatgagatttgggtggggacacaatatcaacatgtatccactattacagtatcatacagagtagttttactgccctgaaaatcctctgtgctctggctatttatccctccttcttccaatccctggcaaccactgatctttttactgtctccatagttttgccttttccagaatgccatataatcgaactcatacagtttgtagcctttccaaattggttctttcacttagtaataacaatttacattttctccatgccttttcatgacttggtatcaagctcattttttcttagttctgaataatatttcattgtcaggatgtgccacagtttatgcattcacctactgaaggacatcctggttgttttcaagttttgacaattatgaataaagctgctataaacatccatgtgtaggttttcctgtggacatacattttcaacgcctttggataaataccaaataatgcaattgctgggtcacgcacatggtaggaatatgtttagttctgtaagaaaccacaaatgccaggtacagtggcacatgcctataattccagcactttggaaggccgaggcaggtggatcccttgagctcaggagttcaagatcagctttggcaacatggcaaaagcccatctccacaaaaaaatacaaaaattagctaggcatggtggcacacgcctgtagtcctagctactcaggaggctgaggtgggaggatttcttgagcccagcagttcaagactgcagtgggccaaaatcacgctactgcactccagcctggacaacacagtgagaccctgtctcaacaacgaaaacaaaaaactaaaagaaaatcaccaagatgtcttccaagtggctacaccattttgcattctcaccaacaatgaatgagattgcatcctcaccagcactttgtgttatcagtgatctagagtttgaccattctaataggtgtgtaatagtatttcattgttgtcttattttgcatttcctgatgacatatgacatatagcatcttgcatatggttatttgccatctgtattcagcatctttttaggtgaggcattcatcaaggtctttggctcatttttaaaattgggttgtttatgttcttattgttgagtttaaagatcttttcttatattttgaataacagtcctttatctgatatgtctttggtaaatattctctcttagaatgtggcttatcttttctttctcttatcggtgtcttttacaaaatggaaaattttgattttaatgaagtccagcttatcaattctttctttgatggatcatgcctttggtgttgcatctaaacagttatcatcatatgatgttagctgtgggcttgttaaaaaaaagttatcatcaaacccaaagtcatctagattttctcctatgttttcttctaggagttatacagttctgcattttacatttaggactctgttctatattgagttcatttttgtgaagaatgcaaggtttgggtcagactaatatttttgcatgtggatatccaattgttccagcaccatttgttgaaagataatcttttctcctttgttttggctttactcctttgtcaaagaccggttgactatttatgtgggtctatttctaggcactctgttttattatttatctatttgtttattctttcactaatactacactgttttaattactgtagctttatagtaagtcttgatgtcgggtagtgtcagtcttctgactttgttcatcttcaatattgttttcgctgttctgggtcttttgtctctccatataaactttagattcggtttgttgatatccacaaaataacttgctgggattttgattggcatagtgttgaatctatagatcaagttgggaagaactgacaccttgacaatattgagtcttccaatctataaacacagaatatctctccatttatttagttctttgatttctttcatcagagttttgtaattttcctcatatagattttatacatatattgttagatctatacctaagcatttgatttgatgggatgctaatgtgaatagtattgtttgtttgtttgtttgtttttgtgacggagtctctctctgttgcccaggctggagtgcagtggtgcgatctcggctcactgcaagctccacctcctgggttcaggccattctcccgcctcagcctcctgagtagctgggactacaggcgtctgcaaccacacgcagctaattttttgtatttttagtagagacggggtttcaccgtgttagccaggacagtctcgatctcctgacctcgtgatccgcccgcctcagcctcccaaagtgctgggattataggcgtgagccaccgcgcctgggcagtatcgtgtttttattttcagcttctatttgttcattgctgacatacaggaaagcaattggcttttgtgtattaaccttgcattctgcaatgccactatactcacttattaattccaggaggattttttgtggcttctttcagattttctacatagacaatcatgtcatctgcaaacaaagttttctttctttcttcccagtctgtatacttatttctttttcttgtcttagctaggactaaggctaagtcttaggattagctcagacttccagtgtgatgttgaaaagcagtgataagaagagacattcttgccttgctcttgttcccaatctcagtggaaaagttgcactttttcactgttaagtgtgatattgggctctacaggatttttttaaaaaatagagatagagtctcaccatgttgcccaggctggtctcgaactcctacactcaagcaatcctcctgccttggccttccaaagtgctgcaattacaggcataagccaccacacccggtctctaggagattttttgtagatattgcttatcaagttaaggacgttctcctatattgagagattttaagaagcagagtgaattaagcagattcacattttagaaatcattctggctacaggctcacgcctataatcccagcactttgggagtctgaggtgggaggactacttgaggccaggagtttgagaccagcctgggcaacgtaaacagactctgtctctacaaaaatttttttaaaaattaaccaggcgtagtggtgcatgcctgtagccctagctacttgggaggctgagacaggaggatcatttaagaccaggagttcgaggttacagtgttatgttcgtaccaatgtaggcggcctgggtgacagagcaaaaccctgtctctaaaaaaaaaaaaaaaagaaagaaaagaaaaagaaaaagcaagtgttggggtgaagaaattagaacctcatatacattgctggcagaaatgtaagatgctgcaactgttatgaaaacagtttggcagtttctcgaaaagttaaccatagaattaccatgtgacccagtaattccactcttaggtgtataccaagaaaattgaaaatagggattcaaacagatacttgtacatcagtgttcactacagcattattcacaataactaaaagatggaaacaacccaaatgtctattaatggatgaatgagtaaacgaattgtggtatatatatacatagaatggaatactattcaatcataaacagatatgaagctctgatacatcctacaacatggatgcaccttgaatacattatgttacttgagagaagacacaaaaggacaaatattgtatgattccacttttatgacatgaagtatctataataggcaaattcctagagacagaaataagattagaggtttcttaggattgaggggagaggaaaatgggaagttgttgcttaatgggtacagaatttttatttgggggtactaaaaagcttttggaaaaatatactggcgtattccacaacattgtatcatggaattgtcacttgaaaatggctaaaaatagcaaattttaacacacatattacaacaataaaaaataaaaaagtaaaggtttgtcaggcatttaataattaatacctttcattgtttttgtctggaaagagtgtgtgcaaagatacttaacaaccaaatgtaatgtgtgatccttgatcggctcttgcattttttttttttttttttgagacggagtctcactctgtcgcccaagctgctggaatgcagtggcgcgattggctcttgctttctaaataaaatgcctataagatattcttaggacaagtgggggaaattaaatcgggaagagaattattatgaaattaatgatcttaggtataataattgtactgcggttatgtagcagaacatctattcttaggagatacatgctgcaatgttaaagggttaagtgttacaatgtctgcaatgttaaagggttaagtgttacaatgtctgtaacttacttgcaaatggtgaccccaaaaaggtgtgtgtgtgtgtgtgtgtgtgtgtgtgtgtgtgtgtgtgtgtgtgtgtgtgtgtgtgtgtctgtgtacgcgctttggaaggctacaattgcgagaagcgcaggtctccgccaccgaagctttagactcataagccgggtcaggccaaattccgctgtgcgtaggggaacaaacggcacaaacggggcacaaaaggggaacaaacggcatacgcaaccgtccccgcgggagccccggcccagctcagcgcacccgccagcatgccccaccctgattggtccacttgctcagctcgccggcacccctatatccaattggcgtagcgcttgctgagcggcggcggcaaccgacgtacacaaggggcttgagcgttctgtggagagagtgcgaggtcaggccatgaacttggggtaagcaggggtaagctggggtaagctggggtaagcaaggtggtcgtcagcggagagggaggcatgtgtgtctgggttgtcccttggagtctttactggagaacgttcccaacctgcgccgccgagaggggcagagcccagttctcgggtagaagatcgaggcagatgggtcggcccttagcgactccacagaccttacgttttcacttaatgactagcattaaaactgccagtgatcccctttcggtcccttatttacctcaggatgaggagggaagagaggtgaggaggaaaggagagaaatgacgagacagttagaggaagcgtggcggctcctggggaggactcctggcccatgccccgggttcttcgccaccttgtttttggagtcttgcagaatgttgaaacgcccaaattcgttttaggcccacgaggcggggaaccaggcttctcaagaaatcgatgtagtaccagtgcctaacacctagtaggcgctccttaagtaggggtgaataaataaaaagggctggtgcatggtcttcatcactcgcaagtttgatattttgagaagatgagaagccaccaaactcagacctaactacacatcgttcagcaaatgttattatgttttagaatctggggatatggaaataaataagatagtgtgtcccttaaggagattacagtgcagtgcgtcattgaaggtactttaccattgaagctcttttctttcttggtgacgtttcaccaacataaacacgaactgttcataaccctacaataaggaaagccgtaaaacctattctttccagtgttttacctttaatagttaaggtgaggtaatttgatttcccctacctgagcaacaccgcaaatttcgcattcctaatcagacctttcccagcctctctctcccttgactggcttgctggatttaattttctctctctgaattatggactgtatgtatgggctgccatttttgttctcagtggagttttaggaccttaacagacgttcaagttttgttggcagtggctactgttactttatgcctttgcttctgatatgcacgtataaagcaccatactaaatatcactatgtattatttgaaatattgaaagtggtactctttgctcaagcagttactaaccttgatggcattgttagtagtcatatcgatgctccagcactccatagaatgttttagtcatgagttcattatgaaactaatgaatggcggttaaatatatcttgttcctttaacttatgtgaggagttttggtaacagcattattaaaaaatggtggtatgataacttaatttatagtttaccaataacaaaatgagatttcaggttaatgataacaatgcttgtagtattgaagagtttcaagaattttccccctgtagttgtgggttttatcttggattgcaaacgtttttaattaaaacactggttcgatgtgtacaagattcctgcataaattcaaaataatggatttattgtcaggttcaaatgaacatttctggttatttaaaatgttgcggtttgttaaaaatgagagacaactttctttttttattacagagatggtttaaagcttgaaactgaattactggatggaaaaaccaagctaatattgtctccatatggtatgttgtgttacagaaatctgaaatgttaacttttaaattcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatttgcccacaccaaaggggaaatttaattcacaaattgtagcatgcatttagcattttcctttaaaaggttgcacttgagcttaagggtaattttccttttaaattattttcccttatcagaaatctattgtgcttttttctacaaaatacattatcactttgtttattttaatttttgaggcagagtctcactcttgtcacccaggttggagtgtagtggcataatcatggctgcagatcttcctcctccagcctcctgagtagctgggaccgtgtgcatgagccaccatgcccagctaattttttttatttttagtagagatgggatctcactatgttgcataggctggaattaccatttaaaaaatttttttgaggttgggcatggtggctcatgcctgtaatcccagcactttgggaggccaaggtgggtggatcacctgaggtcaggagttcaaggccagcctggccaacatggtgaaaccccatctttatgaaaaatacaaaaattagatgtggtggcgctagtcccagctacttaggaggctgaggcagaagaatcacttgaaccctggagatggaggttgtagtgagccgagatcgcaccactgcactccagcctgggggacagagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgtttgtaatggttgatttttatcttctccaggctgatttgttatagaagccacatttgtgaagacattttattgtcattttaaccaactcagaacatctgaagatcccctttataggcctataataaacagaattactggtcttggatttttggtaggcctataataaagttactagtcttggacttttgattactagacttttaatcataaaattctatcagctatctaaaggtgttttagaattttttttttaagagtaactactgtgttctcaactgatgttgagcctaaattgtttactgccttaaagcaaattgtttgggtttatccccattgcatttgggacttcaaaatactgatgcaacctaagtttcccttctgtattgattgttttcaagaagtttctcttcccatattgatagaggttacagagatcctcctcatttcttttttgctcttcacagactataaacaccaaaatcagtagtattttcttccttttttgttttgttttttagtttcccaaatttcacagttctgccactagatgttgaattctcttttctgcaagttattcatgaattatctctgcatagtgcttttctttattccttctaatggggtaagctcctgagttactacaacacctacaggtctctttttttttcccccatttcccactggttgaattattgtaatctccatagtttgttctttaaacacagctgaactctatctcattatcatcaagtttaacatatatgtggtcaaagtgctttcctaattctatcaaaatctgtgcatttttcttttctttttttttttcttttttgaggcaggctctctctctttgtccaggctggagtgcagtgggacaattatggctcactgcagcctcgacctcctgggctcaagggatcctcctgcctcagcctcccaagtagctaggactacaggcgcgtgcccacaccaccaggctcagttaattgtttaaaattttttgtacagacgggagtcttcctgtgttgcccaggcttgtctcaaactcctgggctcaagcgatccttccgcctcagcctcccagagtgctaggattataggtgtgagccactgtgcccagcctctcctacatttttatttttcttcaatctgtggtaatgaagtaaacttggttactttcctaatttcttaggtttataggaagagaaatgggaaaatacagataatacagtatcataagtaatttattaaaataatggattctaaaactcttacacttaaaatagtctcaaagattagttgaactataaaacaataaaaaaatttttatgagtacctctgcacgtgagaatcagtgacatactaaaaggtatttgtaatattagtgctaggtagcacattttatatatatatattttgtttgttttagagatgaagtttcgttgttgttgcccaggctggagtgcagtggcacgatctcggttcactgcaacctctgccttctgggttcaagcgattctcttgcctcagcccctcgagtagctgggattacaggagcccaccaccacgcccagctaattttttgtattttttttttttagtagagatggtgttttaccttgttggccaggctggccttgaactcctgacctcaggcaatccacccacctcggcctcccaaagtgctgggattacaggcatgagccattgcaccctggcccacattttatatttaaaaatgttacttttctctgatttgttctggccttgggatcctggccccatataaattgtgaagtgagctgatattaaacaaatccattgaacattgtctttataataataaaaaatggctgggcttggtggctcacgcctgtaatcccagctctttgggaggccaaggcaggtggatcacctgaggtcaggagttcgagaccagcccggctaacatggtgaaaccccgtccctactaaaaatacaaaaactagccaggcttggtggtgggcacctgtaatcccagctactcaggtggctgaggcaggagaattgcttcaaccggggaggtggaggttgcagtgagctgagatcgtgctgttgcactccagcctgggcaacagagtgaaatgctgtgtcaaaaaaaagtagttaaaaaaatttttttaattgaaaaaaaaaaaaaagagataatgtaggtggtataatctaatgacataagattcaaagctggagtatagtggagatgtcctataacaactataataaaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttatagttgtgccatattttaaggttagtgttcagaatattaagaaacctagtttctgtggattttagaaaaaatgttagtacaaaaaactattattatacttattttagaatataggaggctttactcatatttaaaatagttatatgaaacattgtttaaaaacaaattacggtatttccagtgaaaattaaggaaaccttactatgactatttgacttgagttactgaaaaacattgctttcctggccacagcatttactcttcctgttcctcattccatgctaagaaatggcagtactttttttaaaaaacaaggttaacacagatttggaaggaacagtagagtgttacatgctttgtctttcacaagtcctggcattgtattgtgtttttaaaagccttctaatttccactttgggataaggaattgcgaatatgaagacaatagaaatatctaaaattttattaggcaatagtgaaataaataaaaaattaacagttcacatggagaggccccacaaatggtttggggacccattaactcctgaatattcccgtgatactcaagatggaattatttactctcttgttatagattattcttggtaaaatgagggagctggattttgtctttaaggctaaaattctagcaacaacctgcttattaggcataacgagaaatcatatcaacaaagttaaaagcagaatttgcctaatcacgtagactttcatgatttctttctcttcactgggagaactagcacattcaaaagaaatcagaacattttttgagccatcctgtgagccctctaaaacatctgattttgatattatagctgggcatagagacaattcatgaaaaggttttccactgatttcacagctaaataagaaaaataacgtcaaggtaatgagtatttatcaagatatttgtattcccctttaggttgtgatttgtgttataatttttattttatttatttatttattttttgagatggggtctcgctttgtcacccaggctggagtgcagtggcacgatcttggctcactgcaagctctgcctcccgggttcacaccattctcctgcctcagcctcccgagtagctgggactacaggcgcatgccaccacacccggctaacttttttttttttttcttttttttgtatttttagtagagacggggtttcaccgtgttagccaggatgatctcagtctcctgacctcatgatccgcctgcctcagcctcctaaagtgctgggattacaggcatgagccaccacacccagccatataatttttatttttattttttatttattattattatttttttagatggagtctcgctccgttgcccaggctggagtctcgctgcgtcgcccaggctggagtctcgctgcatcgcccaggctggagtgcagtggtgcgatctcggctcactgcaagctccgcctcccaggttcacgccattctcctgcctcagcctcccaagtacctgggactacaggcgcccgccaccacgcccggctaatgttttgtatttttagtagagacggggtttcaccgtgttcgccaggatggtctcgatctcctgacctcgtgatccgcccaccttggcctcccaaagtgctgggattacaggcgtgagccaccgtgcctggccagtttttatttttaaaagcatgctggcaagaggaaatggagatttgttttctgttgttgctcgcttgttttccttatttgatataagaaattgtatggctatggtcatgagcaagccatttaacctctgggcttcagtttcctttgttttgttttgttttgttttgttttgtttttttgagacgacatctggcccagactggagtgcagagtgcagtggcacaatctcagctcactgaaacctccacctcttgggctcaacccatcctcccacctcagtgtcccaaatagctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatataaaaactaaaataaatggccagatggctgacacttgtccaccatgttgaggttacagaaacaataggggttggagcatggcaaaacagattatgggagggggaggagaggcaacctggccagtaaaagtgtttttttgttttgttttgttttgttttttgagatggggtctcgctgtgttgcccaggctggagtacagtggtgtgatctcggctcactgcaagctccacctcccgggttcacgccattctgcctcagcctccccagtagctgggactacaggcacccactaccacgcccggctaatttttttgtatttttagtagagacggggtttcactgtgttagccaggatggtcttgatctcctgacctcatgatccacctgcctcggcctcccaaagtgctaggattacaggcgtgagccaccacgcccggccaaaagtggttttattatgtacatgagacctcaaaggtagtagccttcagagaacagatgacaaatgtttccttcagacctttaaaggtgtcagactcggttaatttatcctagatctggacaggggagaatcctcagagaaagcctggctgcgtcattgcagattttctctacagatgcaaatcttccccacaaaagacagctttgcaaggctacttctgtttgtaggccctctgaacagccatcttgaaatgtgtcaaattaatacattttggggtaaaacactgtagttccctttaaagtatagttatccctcagtatccatgagagactggttcaaggatagtcttcccacttcagggtgccaaaatgcacagatgctcatgtggaatccatggatatggagggcctactgtatatcttttagtatgatattatcaaaagtcgtattttataatatttgacatctagagtagttctctacaaatgcttaagaaacttagtggtttcataatgccttaggtcgtgtctttttgttactctgaagtgtgcaccaaaaacattaatgtcatcagtacattctgcagcccttgtaaggtcaaagatttgtaaacttttcccatttcctggaaatccttttttataatttttgatagcagacatcctatgcgtttaaggatggttttactaaaaactaattgatttcacttttttaaataaccaaaacattctaatgaagaagaatcattgttgtatcagacagtatgtattctagacagaaataagcttattgctttctttcagctttggaccttataacagaaaaatctataatttctgttagagtcttgaaatttcgttagtgactaagaaatatccattacttcttcgactaaacttggagtctgcgtatcacaatctgcaaaacatgtgacgtaacagttgtatttcttaggaatagctatgctaaaggcatgagatgggcttcaccctagttgaaaaacaagaaagtcttgtgaggccatcactaacttggctgggatagatgatttagaaaaagagataagcaagaccagctgagtggctcacatgtaatcccagcactttggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaattttaacccatagttctctacttcagaattctagcttttaattctcttaataataattgaatgaacattacaggaaactagaacctcgtgataattgacaaagtataaaataagttattccaataaaactgctccttattggtaattgtgataataaaattgtaccatacttaactttggttctgattaaattttttcttattctgtgtccctaaaaaattattctccactttgtgagttaatctccttcctaaaaaagagttttgattagatctgtgttggtatctgcattaagaaggtcagatttgtttacatggttctgtttttacagtttttgtacatttttttaaaaaggacattatttacagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaaaaaaaaaagttttttttttgagacggagtttctctcttgttgcccaggctggaatgcagtggcacagtctcagctcactgcaacctacccctcccaggctcaagcgattctcctgcctcagcctcccgagtagctaggactacaggtactcaccaccatggccagctaattttttgtattcttaatagagatggtatttcaccactcaggatggtctcgaactcctggcctcatgtgatctgccagccttgacctcccaaagtgctgggattacaggcatgagccaccgtgcccagcctatttaaaaaaacttgtcatatttttgggttttttgtatgtgtgttttttttaaaaaaagaaacagggtcttgctctgttgctcaggcaggtatgcagtggtgaaaacataattccctgcagccttgaacttctggactgaagggatcctcctgcctctgcctcccaaatggctggtactacaggtgtactccaccatgcccagctaattaaaaaaaattttttttagagacagggtctcactgtgttgctcaggctggtgtcaaacttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaaggagagaatctaagtcctccttatttttagttatcagttaatttttacttgagtgtattatgcttcatttgctatcccttcctccttgtgaacatttacattttagcaaatgtattctgaaaataatgtagtaacctgaagggatgattctcctaaagagatgattctggtggtagaaatttttggcactatggcctaattaggtaaatttcttatagaaacccttcaagttaaattttgtgcatggctgtctgttctgcttcatgtagagctgacttgcctacattgaatacttttgttgtctgttgataattttacattaacaaaaggaatgaaatctgaattgcatttgcccacaatcccaaaagcacattgactgaaaaggcaataaggttgtcttggtagaactcattttggaaaattctgtagctctgggtgataattttaagtgtgtaaagtttagaagttgtatgcagacaccgttaaaagttgtagctaaaactaagttttcatgaagttggtgaggatccgttgttggcttatttacttttcaacatcaggataaaaaatctgtaatactaaaaatgttaaataatttcagttgccaaattttcagttgaaatgtcaatatataatttatttcttaatttgcatggctttttaggtcatttattatctggggataatccataccatgattgttaatgcaagtaaagaaccatttgaggtgacatttaggttttaaaatattttgtatatattttttaatgatagtatttgtcagttgatgaaatgacgaggctcatgaatttggaaaggagaactttatttctcatcagcagttgcaacctgcagcatggccattctgacaggctgggaagcatagccttcggccaaccaggagccagaaacttcaaggtgttggggaagggaacaggaatttatgctgagtgaagtggctgaatatacgtatttaataagcatagaaggagtcatgaatatttatgaaaggagaaacatccatgcacaattgagttttatgccccttcatgggtcccatgtacaaaaaatgtcagcgttagcatgatccaagggtagagttttcagccctctgacatcaaaaagtaaagcagaggacacaaaaaccttttggacagaagcatcaggtggttggttggtatcagtgctgacatcttctgaagggctggtttctgtttagcccttaggctaaatagtggttagccagggagggaggaggtataatgtggtgtgtctgatttccccatccactcatggccaagaactcagttttcaaggcactttggggtccttggccaagagatccattcagttggttgggggacttagaattttacttttattcctcatgtgtatctttttttaaataactaaaaaaaaacaataaagttatttaaaaaatttttggaatcaaaagttgtgggggttgatgatgggagaaggactagaaaacgaaacacatgctatatccaggactggacaaccaagagttaaaagagtatgattattggctcattttttttactatttaaatgcagttttcgctgggtgcagtggctcatgcctgtaattccagcactttgggaggccgaggtgggcggatcacgaggtcatgagattgagaccatcccagccaacgtggtgaaaccccatctctgctaaaaatacaaaaattagctggacatggtggcacgtgcctgtagtcccagctatttgggaggctgaggcaggagaattgcttgaacctgggaggtggaggttgcagtgagctgagatcgtgccactgcactccagcctgggcgacagagcaagactctgtctcaaaaaaaaaaaaaaaatcagtttttatgtatttgtatgcgaatgtggtacaaaattggagagatgttattgagggaaaaggaatttgctgtgtaacaaaaaagccctcttctcaaataccttagagcagttgttttcagaaatcccagctgtagccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaaaaaactttctagatccagaagaaaattaggttgaatgaaaagagggccaatttgaaggtatatcataataagtttgcaaatatcaagaataaggatatacttcttcaagcatttaaatatgagaaaatgacaacaaaaatcaaagtaaccttagttttcttctctgtatatagtatagcaatatttataagggtttaataaatagagctaaaatatttaatgcctagacaagatgttcatttataaagagaacatagacatactcagacctgaataattacataaaatatttctcccaaatatttcttttaatacaaaagttcttaaagatcatttctggatcagaaaaatgggtcaaaattaaaacaatttacaagaattttgtggttagaaagtaatgagtagctgacacaaaagtctctaagacattgtgaaatgaaaagagtaatgcatatactataaccatatctatatttaaagaaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgagaccatcctggccaacatggtgaaaccccatctctacttaaaaaatacaaaaaaattagccgggtgtggtggcgcacgcctgtaatcccagctactcaggaggctgaggcaggggaatggcttgaacctgggaggcaaaggttacagtgagctgagatcacaccactgcactctggcctgggggcagagcaagactctttctcaaaaaaaaaaaaagaaaaaaagaaaactaaagtaatcattagtataattataaagagtatctgccaacatagtttgtacagtaaacatcaagataaatagtaatagcaagataacaagaatcaactctgaaaagtcaaaaatcctttgttaaaaagcagagatatgaaaactccaaagacttgatgcttaaaagagacatacttacaataaaattatacattattaaaaattatgggctggatacagtggctcatgcctataagcccagcactttgggaggccagggcagaagagtagctgccttgagccaagagtttgagaccagcgtgggcaacatagtgagaccctgcctccacaacacaaaaaaactaaaaaattagccgagcatggtgggatgttcctgtagtcctagctattctggaggctgaggtgaaggaattactttagcccaggagttagaggctgcagtgagctatgattatgcttgggccacagagcaagaccctgtctctaaaaagagataagatgccaatatattattactatttgtattggtggttctaggcaatataacaaggaaaataaatttcaagtcctaagaattggagaggaaaaaatgaaagtgtagttattcgtcatgtgtatagaaaccccaaagaatctatagatgaaatattcaaagtaaaaagtgagaattaataatttattaggctataaaagtctcaacaaatttcataggttcacattacatagaatgttatagtggattttattagtttgttctctcattactgtaaagaaatctctggggactgggtaatttataaagaggtttaataggcttacagttttgcagactatacagaaagcatagtggcttctgcttctggggaggccccagggagctttcagtcatggtggaaggcaaaatggaagcaggcatctaacatggcagaaacaggaccaagagagaagtagcagggagggctacacacttttaaacgaccagatcttaccatgaaaaacaatgtggagattccttaaagaactaaaagttaggctgggcgtggtggctcatgcctgtaattccagcactttgggaggcctaggcaggcggattacctgaggtcaggagttcgagaccagcctggctaatatggtgaaaccccgttccctaaaaatacaaaaattagccaggcgtggtagcaggcgcctgtaatcccagctactcaggaggctgaggcaggagaattgcttgaatccaggaggcagaggttgcagtgagccgagatcgcaccactgcactccagcctgtgtgacagagactccgtctcaaaaaataaaagtaaaataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcagtcaatgagtggataaagaaactgtgagatagatatagatatggatatatgatggaatcctactcagccataaaaaggaatgaatgaatagcatttgcagcaacctggatggagttggagagtattattttaagtgaagtaactcaggaatggaaaaccaaacatcttatgttctcactcataagtgggagctaagctatgaggatgcaaaggcataagaatgatacagtggactttgaggacttatggagaaaggctgggagggggctgagggataaaagactacaaattggattcagtctatactgctcgggtgatgcatacaccagaatctcacagatcaccactaaagaacttactcatgtaaccaaataccacctgttcccccaaaacctatagaaataaaaatttttttaaaaagtaattgcagttttacccattactttcaatggcaaaaaccgcaatttacttttgcatcaacctaaaaaataaaaagatctcatgagaacttatcgcaatgatagcaccaagtggggtgatgttaaactatgagaaaccatccctgtgatccagtcatctcccaccaggccctacctccaacactggggattacaattcaacatgagttttgatggggacacagaatcaaaccatataatggaattaagctagatatcagtaacaaatagtaactagaaaattcccaaatgtttgataattaggcagtatacttctgactgaaagagaaattcacattagaaaatatttttaactgagtgataatgaaaatattacatatcaaaatgtaggtttcctgtgctgagagggaaatttttcaccttaaatgcatctcttgaaagactgaaaatcaaggaatagtgacctaaagtattcatctcaagaggttagagaaagaacagcaaaattgaagcccaaggtaggtcaaagtggatattagtaaaactggaaatacctacaataaaattaacaaagccaaaagttaattgtttgaaaagttatttaaattgataagcccctcataaaatcgagatgaattaaaaaggagatattaccagagaatatgacattagaaagagaaggggattttctgaataacttcaccaataagttagagaatttgggcttaaaaatgagcaaattattagaaaaacatagattactaaaattgacacaagaagcagtaaatcagaatggtactatctttattaatgaaattgagcttattactaaaaacccaacaaaataaactccagaaccaaatgtgtttactggtgaattcttcccaacaaaggtagaagtgaaaaccttttaggttgtttataagggtagtaaacctgatacccaaaactaacattttttaataccaaaacccaacaggaaatataagaaagaaaaataaatacaagaaagaataataaatcatgatgagttgggtctattcaatgaatgaaagcaagctaggtttaacattcacaaatcaatgatagtcatcatatttataaaaataataggtaaatttaataaaagtggctagacacaagaattaatgtaccagtgtcattagcacaacattgaaaggatgatctgttaaaaagtaattgatgaatgacctaatcacaagttctgttcttggaaggttaaagttaatattataaaatagagggagaaaatgtttgcagattaatccttgataaaaggacttacatccagcatatatttttaaaaactaaacattcactaattagacaacccaatttttttaattggcagaattttaatagacatggctccaaagaggatatatggcaaataaatacatgagaaacggatttttagccatttgttaaacctctatgggccctctggttccagagggaatttaattaatttttaagttcaaagtaattttgttttttaaaaagtgatttcagctctgtgttttgctgctgttcctcctgtaaggtaatgaatggtctttgtaatccagtgtcccgacatccctaccacccacatgaataccttttctgcgtggccagtagacaaggtcggcaggtggatgttgtcatcttaactggggaatcatgaactggcaagaagggctgttctggcccatggcaaagtcaacactgagtgttctttcccaaagctgcatttttataagactgctttaaggggagaattacatgaaatggaaacaggcatctgtagtggaccatttgaaaagccctttattttcagttgtgacttaaccagctgccatttgtacagcatttgaatcaggagtgagactaagatttcctaacagaataatttgaagactgaaagaattacattaggactctgtaacatcaggaactattttaggggaaggttgtagtgggtttcctatgagttttcacacaaggctgtcatgtgagaataggccatgtgcagtggctctttgggagatcaaggcgggtggatttcttgagcccaggagttcaaggccatcctgggcaacaacatgataaaatcctgtctctacaaaaaaataaaaatagccgggtgtggtggtgtgcatctgtagtcccagctacttgggaatctgaggcaggaggatcacttgagcatgggaggttgaggcagcagtgagccgtgattgtgcactccagcctgggtgacagtgagaccctgcctaaaaaaaaaaaataaaaacacaaaagagaataggctccaaacacgtttaggaaaccagtttttatgtaggggaagtctcaggtcaataatagggagatagagtgaaaaagtcagttagcctgggaaaagaggcttctttctttaactgtatggaggatttagtgagagggaatgctagaagaaggtcaaaacaattgttacagtgtgtcttgtgttatacacaaatatgccttactcaccttcaactaaatgcatgcagtaaaccaaaaggaatgcagttctacctactacctctccccatctcccacccccatgtttttcattcttctaactgaatgcacattgggagagacttgtgaaaaagaatgtaagaataatgtaaagcctttcccagtcaacgacagaaatgaaatgcagttaagtggtagtagctttgtaagacatccttgagtaagaaattaaagactcaactgagagatctaattgttcagttatcttagggttatgaatatagataaaacattttgagtgtttaaggaatttttaagggtaattttaacttttgtctaatccctgaataatttgcaatgccactacactaaaatatggaatcagatctggttacatcaaacttaaacaaatatacagcatccactcttttagcttccctgggtcacactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacctcccgggttcaagtgatttgtgtctcagcctctcaagtagctgggattacagacatgcaccaccacagctggctaattttttttttttttttcagtagagatgagattttgccatgttggccaggggctggccttgaactcctgggctcaagtgatctgcccatgtcagcctcccaacatgctgggattatagtcatgagctgctgcatccagctgaattttgaaagtcttttaattgttttggagaaagaattttctgtttttcattagaaaattcccttcccttacacttagatatcttattatatatctctgatctagtatatttaaaatatgattctgagaatcagaatatatctacttaattctttgaattcaaattcgtttgaagttattgctcctcttacagataaatgcctcagtggattaaatctgtatgttactttggcaagatttgcacatattaagtgattagaaaaagagaactgaactttagatggcttttatggctgttgtttaggaaacagtactgctggagcaccctttcagtgctgtgaaacaagaactgcaaagaaaatggattgaagagttgaataagcaaatagaagatgaccgtcaaagaaaaatagaggaaaaaattatatattcaaaggtaacttatgaggttttgtggctataaaagaaaaaataaaatcaaagtctttaatcaattaaaactagaagtattctgaaactcttgacaagaccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttaggttagtactggtttttttttttttcatcaatttatttctcctgagttctgtttaagatgagaattcattctttgaatagggattgaactagaattatgactaagaaatctaatgcataatggccgggcacggtggctcacgcctgtaatcccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcagagcttgcagtgagctgagattgtgctactgcactccagcctgggcgacagagtgagactccatctcaaaaaaaaaaaagaaatctaatgcataatataagaaaggaggctaaaattaaaattaaaacttcctgtcctgattttagcctaatgctaaagggactttaatatctgcataattcttcaaatcctttgatatatgaatttggcatcattaatgttatgcttagtcagtgagcagacatttgcagagcatctgctacttaacaggcactatgctaagcactgagattatttcttcagttttttttaataccatttcctccagtagccctcctagggttgaagaaaaggcatgtagaacttgacagtacaaatgggagatgggagaaatgcattggaaatttgacatttccacttcacttatataaataatactttcagtatgctgataaaaacttatttctacagtcaccaaactaatgcttcatggattttaaaaattgatatataatgttttatatatttataggatacatatgatattttgttatatatgtagaatgcgtaatgattcagccagagtattctggtatctatcaccttgagtatttatcatttctgtgttgggaacatttcaagtttactagccaatttgaaatatataatacattgttgctgaccatagtcaccttactattgctatcaaacattagaacttattcctttcatctaaccatatgtttgtacccattaacctacctctcttgatcactaccaccctcacacacacccttcccagcctttgatacctatcattccattctttagctcgttgagacctacttttttagctcccacatatgagtgggaacatgtgatgtttatctttatatacctggcttatttcacttaacataatgacgtccagtcccatctgtgttgctgtaaatgacaagattctattctttctttatggccaaatagtatcccattgtgtatataccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggtctcgaccacaaactctataccagtgtcttgaagtgttttccgtatgttttcttctagtaggtttacatttttgggtcatacatttaactatttaatccatcttgaattttttttttttttttttttgaagtggagtctcagactgtcaccctggaatgcagtgacgtgatcagctcactgccgcctccacctcccaggttcaagcaattctccctgctcagcctcctgagtagctgggattacgggtgcatgccaccacacctggctaattttttttttttttttttagtacagatggggtttcaccatgttggccaggctggtcttgaactcctgaccttaaatgatccacctgccttgccctcccaaagtgctaggattacaggcatgagctaccacaccagcccttgaattgttttttgaatatggtgagagatggggctccaatttcattcctctgcatatagatatccaattttccaagcattatttattgaagagtgtgtgctttccccaactatgttcttgacacttttgttgaaaatcagttggctgtaaatacatggatttatttctggattccctattctgttccattgatctatatgtctgtttttataccaataccatgctgttgtggttcctatagtcttgtaatgtattttgaagtcaggtagtgtgatgccttcagctttgttcttttgatccaccttgatttggttattacggctcttttttggtttcatagaaagttttgaattttttctacttctgtgaaaaatgaaggtggtattttgatagagatagcattgaatttgtagattgccttaggcataattcttctgatccatgaacatgggatgtcttgccatttgtttgtatcctctttcgtttatttcatctgttttgtagttttttatgtagaaatgtgtaacccccttggttaaatttattcctagatattttattgttttgtagctattgtaggtgggattgccttctttatttctcagctagtgtatagaaatgctactgatttttgtatgttgattttgtattctgcaactttactgaatttattgatcagatgtgaggtttttgtggagtctaggttttgttttggggtttttttttttttttgagacagagcctcgctctgttgcctaggctggagtgcagtggcgcgatctcatcccactgcaacctctgcctcacaggttcaagcgattctcctgcctcagccttccaagtagctgggactacaggcatgtgccaccgcaccttgtaatttttgtatttttttagtagagatggggtttcgcagtgttggccaggctggtctcgaactcctgacctcaggtgatccacccgccttggcctcccaaagtgctgggatttcaggcatgagccactgtgccagtggagtctagggtttttaagatataagatgataacatcagcaaaggggacgttttgattttagtttgttttgttttgttttgtttgtttgtttgtttgtttgtttgttttgagacagctctgtcacctaggctggacttcagtggcacaatgttggatcactacaacctccaccttctgggttcaagcaattcccatgcctcagccacccaagtagctggaattacaggtgtgtgccaccatgcctgggtaatttttgcataggggactttttattttattttatttattttctattttatttattttatttattttctaatttaggtgccttttatttatcttgcctggttgctctggctaggacttctgttgctatgttgaataagaatggtgaaagtgggcatccttgttttgttttagctcttaggggaaaggctttcagcttttccccattaagtatgatgttagctgtgggtttgtcatatatagtctttattattttaaggtatataccttctgtgcctagtttgttgagagtttttattatttagtgatgttgaattttgtgaaatgttttttcttgtctactgagatgatcatatggtttttgtctttcattctgttgatgtgatgtatcacatttattgatttgtgtatgttgaattctgcctgcatccctgggataaatcccacttaattattgggtattagttttctcatgtgctgttggattgagtttgctagtattttgttgagaatttttgcatctatgttcatcaaaaatagtggcctgtaattttctttgttcttttttgttgtgtccttctctggctttggtatcagggtaatgctggcctcacagaatgagttagggaaaattccctcctctttgatttttttggaatagtttgggaagaattggttagttctttgatagtttggtagaattcattagtgaagttgtctggtcctggactttcctttgttgggagacttttttattaccaattcagtcttattactcattactggtctgttcaggttttctatttcttcctgattcaatcttgatagcttgtgtgtctccaggaatttatccatttcttctagattttctagtttgtctgtgtgtagttgttcataatagcctctgatgatctcttgtatttctgtggtatcagttgtaatttctccttttttattcctgattttatttgggtcttctctcttcggttcttggttagtctatcaagtagcttattggttttgtttatcttttaaaaaatctttgtttctttgatcctttgtattgtgtgtctctattttgtttaattctgctctagtgtttgttatttctttccactaatttggggtttgttcttttctagttccttttaggtacatcattagattgctttttgaaatgtttccacttttttgatataggcacttattgctaaaatttccctcttagcactgcttttgctgtatcccataggttttggtatgttgggtttaaattttcatttttttcaagaatttttttaaattttttccttgactggatgcttgttcagaagcatgtggtttaatttctatttattggtacagttgccagtgttcctctcattattgattactggttttgttccattgtggtttgagaagatacttgatatgaagtcagttttttaaagtttgttaagatttgttttgtgtcctaacatatgatctgtcctggagaataatccttatgctaatgaaaagaatgtgtattctcttaactgttggatgagatgttctgtgtccatgtgttctcatggttcaactcccacttatgagtgagaacgtgcagtgtttggttttctgttcttgtgttagtttgctgagaattatggtttccagcttcatccatgtccctgcaaaggacatgcactcatccttttttatggctgcatagtattccatggtgtatatgtgccacattttctttatcgagtctatcattgatgggcatttgggttggttccaagtctttgctgtagtgctgcaataaacatacatgtgcacttatcttttttttttttttttttgagacagagtcttgctctgtcgccaggctggagtgcagtggtgcaatctcagctcactgcgacctctgcctcccgggttcaagtgattctcctgccccaccctcccaagtagctgggattataggtgcccgccaccgtgcctggctaatttttgtatttttagtacagagagcatttcaccatgttggccaggatggtctcaatctcctgaccccatgatcgggctaccttggcctccaaaagtgctgggattacaggcatgagccaccgcgcccggctgcatgtatctttatagtagaatgatttataatcccttcggtatatacctagtaatgggattgctgggtcgaatggtagttctggttctggatccttgaggaattgccacactgtcttccacaatggttgaactaatttacgctcccaccaacagtgtaaaagcgttcctatttcaccacatcctctccagcatctgttgtttcctgactttttaatgatcgccattctaactggcatgagatggtatctcattgtggttttgatttgcatttctctaatgaccagtgatgatgagcttttctccatatgtttgttggctgcataaatgtcttcttttgagaagtgtctgctcatagtcctttgcctactttttgatggggttgtttttttcttgtaaatttgtttaggttctttgtagattttgaatattagccctttgtcagatgggtagattgcagaaattgtctgccattctgtgggttgcctgttcactctgatgatagtttcttttgctgtgcagaagttctttagtttaattagatcccatttgtcaatttcagcttttgttgccattgcttttggtgttttagtcattttgtccatgcctgtgtcctgaatgatactgcctaggtttacttctagggtttttatggttttaggtcttacgtttaagtctttattccatcttgagttaatttttgtataaggtgtaaggaaggagtccagtttcagttttctgcatatggctagccagttttcccaacaccatttatgaagtaaggaatcctttccccattgcttgtttgtgtcaggtttgtcaaagatcagatggttgtgggtgtgtggtgttatttctgaggcctctcttctgttctattcatctatatatctgttttggtaccagtaccatgctgctttggttattgtaaccttgtagtatagtttgaagtgagacagcatgatgcctccagctttgttctttttggttaggattgtgttggctgtttgggctgttttttgattccataggaaatttaaagtagttttttccaattctgtgaagaaagtgagtggtagcttgatggggatagcattgaatctgtacattactttgggcaatatggtcattttcacaatattaattcttcctatccatgagtatggagtgtttttccatttgtttgtgtcctcttttatttccttgagcagtggtttgtagttctccttaaagaggtccttcacgtcccttgtaagttgtattcctaggtattttattctcttagtagcagttgtgaatgggagttcactcatgatttggctgtttgtctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagagacaacttaacttcctcttttcctatttgaataccctttatttctttctcatgcctgattgccttggccagaacttccaatactatgttgaataggagtggagagagagggcatccttgccttttgccgtttttcaagggaatgcttccagtttttgcccattcagtatgatattggctgtgggtttgtcataagtagctcttattatttttagatacgttccatcaatacctagtttattgagagtttttagcatgaagggatgttgaattttgttgaaggctttttgtgcaactattgagataatcatgtggtttttgtcattggttctgtttatgtgaatagattacgtttactgatttccatatgatgaaccagccttgcatcccagatatgaagccaacttgatcgtgctggataagctttttgatgtgctgctggatttgatttgacagtattttgttgaggatttttgcatcaatgttcatcagggatattggcctgaaattctctttttttgttgttgttgtgtctctgccaggttttggtatcaggatgatgttggtctcataaaattaattagggaggattccctctatttctattgattggaatagtttcagaaggaatggtaccagctcctctttgtacctctggtagaattctgctgtgaatccgtctggtcctggacttcttttggttggtaggctattaattattgcctcaatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgttttacttccaattgtgtggttaattttagaataagtgtgattaagtcctcagaagaatgtagattctgttgatttggggtggagagttctgtagatgtctattaggtctgcttggtccagagctgagttcaagtcctgaatatccttgttaattttctgtctcattgatctgtctgatattgacagtgggatgttaaagtctcccattatcattgtgtgggagtctaagtctctttgtaggtctctaaggacttgctttatgaatctgggtgcttctgttttgggtacatatatatttaggatagttagctcttcttgttgcattgatccctttaccattatgtaatggccttctttgtctcttttgatctttgttggtttaaagtctgttttatcagagactaggattgcttttctttctctccgtttgattggtaaatactccttcatccctttattttgagcctatgtgtgtctctgcgtgtgagatgggtctcctgaatacagcacactgttgggtcttgattctttatccagtttgccagtctgtgtcttttaattgggacatttagcccatttacatttaaggtttatattgttatgtgtgaatttgatcctgtcattatgatgctagctggttattttgctcattagttgatgcagtttcttcatagtgtcgatggtctttacaatttggtatgtttttgcagtgggtggtaccagttgttcctttccatgtttagtgcttccttcaggacctcttgtaaggcaggcctggtggtgacaaaatctctcagaatttccttgtctataaaggattttatttctcctttgcttatgaaactgagtttggctggatatgaaattccgggttgaaaattcttttttttttttaagaatgttgaatattggccccaactctctcctggctcgtagagtttctgcagagagatccgctgttagtctgatgggcttccctttgtgggtaacccgacctttctctctggctgcccttaacattttttcctccatttcagtcttggtgaatctgatgattatgtgtctttgggttgctcttctccaggagtatctttgcatttcctgaatttgaatgttggcctgtcttgctaggttggggaagttctcctggataatatcctgaagagtgttttccaacttggttccattctccctgtcactttcaggtacactaatcaaacgtagatttggtcttttcacatactcccacatttcttggaggctgtgtttgttctttttcattcttttttttctaatcttgtctttttgctgtatttcattaagttgatcttcaatcactgataccctttcttacgcttaatcagtttggctattgatacttgtgtatgcttcacaaggttcttgtgctgtgtttttcagctccgtcaggtcatttatgttcttctctaaacggttattctagttagcaatttgtctaaccttttttcaaggttcttagcttccttgcattgggttagaacaggctcctttagctcggaggagtttgttattacctaccttctgaagccttcttctgtcaattcgtaaaactcattctctgtccagttttgttcccttgctggcaaggacttgtgatcctttggaggagaagaggcgttctggtttttggaattttcagtctttttgtgctggtttctccccatcttcatggatttatctacctttggtctttgatcttggtgacctttggatggggtctctgagtggacatcctttttgttgttgatgctaatcctttctgtttgttagttttccttctaatagtcaggcccctctgctgcaggtctgctggagtttgctggaggtccattccatatcctgtttgcctgggtatcaccagcagaggctgcagaacagcaaagattgctgcttgttccttcctctggaagcttcgtcccagaggggcacccgtcacatgccagccagagctctcctgtatgaagtgtctgtcagcccctactaggaagtgtctcctagtcaggatacatgggtgtcagggacccacttgaggaggcagtctgacccttagtagagctcgaatgctgtgctgggcgatccactgctctcttcagagccatcaggcagggacgtttaagtctgctgaagctgcacccacagccaccccttccccctggtgctctgcctcagagaggtaggggttttatctataagcccctgactggggctgctgcctttttttcagagattccctgtccaaagaggaggaatctagagaggcaatctggccacagcagccttgctgagctgcggtgggctctgcccagttcgatcttccaggccgctttgtttacactatgagggtagaaccacctactcaagcctcagcagtggtgggtgcccctcaccccaccaagcttgagagtcccaggtcaacctcagactgttgtgctggcagggagaatttcaagtcagtggatcatagcttgctgagctccctggggataggaccctccgagcctgactacttgcaaggctccctggcttccgccccctttccaggagagtgaacagttctgtctcactggcattccaggcaccactggggtatggaaaaaaaactcctacagttagctcggtgtctgcacaaacggccgcccagttttgtgcttgaaatccaggccctggtggcataggcaccagagggaatctcctggtctgcgggtggcgaagactgtgggaaaagcacagtatctgggccagagtgcaccattcctcacagcatggcacatccctcatggattcccttgggtagggaagagatttccctgaccctttgcactttctgggttgaggtggcgcctcaccctgcttcggctcgctctctgtgggctgcacccactgtccaaccagtcccaatgagatgaactaggtacctaagttggaaatgcagaaatcacccgccttctgtgtcgatcttgctgggagctacagaccggagctcttcctattcggccatcttgccaacaaccctccatcttctagaatttttatagtttcaggtcttaggtttaagccctgaatccatcttgagttgatttttgtataaggtgagagatgaggatccagtttcattctcctatatgtggctagccaattattccaacaccatttgttgaaaagggtgtcctttccccacttcatgtttttgtttgctttgtcgaagatcagttggctgtaagtatttgggtttatttctgggttctctgttctgttccattggtctatgtgcctatttttatatgagtaccatgctgttttggtgactgcggccttatagtatagtttgaaatcaggtaatatgatgcctccagatttgttctttttgcttagtcttgctgtggctatgtgggctcttttttggttccatatgaagtttagaattgttttttctaactctgtgaagaatgatggtggtattttgatggggattatgttgaatttgtagattgcttttggcagtatggtcattttcacaatgttgattctacccatccatgagcatgggatgtgtttccatttgtttgtgtaatctgtgatttctttcagcagcgttttgtagttttccttatagaggtctttcgactcctttgttaggtatattcctaagtattttatatatttttttgcagttgtgaaagggcttgagttcttgatttctctgcttggtcgctgttggtatatagaagagctactgatttgtgtccattaatcttgtatctggaaactttgcagaattattttatcagttctaggagctttctggaggagtcttacagactcctaaggtaaacagttatattgtcagcaaacagggacagtttgacttcctctttactgatttggatgccctttatttatttctgttgtctgattgttctggctgggacttccagtactacgttgaagaggagtgatgagagtgggcatccttgtcttgttcctgttctcagagggaatgctttcaacttttccccattcagtattatgttggctgtgggtttgtcatagattgcttttattacattaaggtatgtcccttgtatgctgattttgctgagggttttgatcataaaggatgctggattttgtctaatgctttttctgcatctattgagatgatcatgtgatttttgttcttaattctgtttatgtggtatattacatttattgagtatgttaaaccatccctgcatccctggtatgaaacccacttgatcatggtggattatctttttgatatgttgttagattcagttagctagtattttgttaaggattttagcatctatgttcatcaaagatattggtctgtagttttcttttttgggtgtgtcctttcctggttttggtattagggtgatgctggcttcatagaatgaattagggagggttccttctttctccatcttgtggaatagcgtcaaaagaattggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaattacaagtttgggagctacagtgttaggtgcatatatgtttaggattgtgatgttctcctgttggaccaggccttttactattatgtaatgtccctctttgtctcttttaaccactgttgctttaaagtttgttttgtctgatataagaatagctatcctgtttgcttttggtgtgcatttgcatgaaatgtgtttttccgctcacataaacttaaagtttaggtgagtctcctaagagggcagatggttggtaagttcttatccattctgcagttctgtatcttttaagtggagcctttaggccatttacattcaatgttaatattgaaatgtgaggtactgttgcattcatcatgctgtttgttgcttgcgtactttggatttgttttttgtttttgttttttaacttgtatttttgttttataggtcctcctgtgtgatttatgttttaaagagattctgttttgatgtgtttccaggatttgtttcaagatttagagctccttttagcagttcttttagtggtggcttggtaatggcgaattctctcagcatttgtctgaaaatgactatatgatgcttagttttgccaaatacaaaatttggctgataatttttttgtttgaggaggctgaagatagggccccaatctcttctagcttgtagggtttctgctgagaaatctgctgttaatctgataggttttcctttataggttacctggtgcttctgtctcacagctcttaagattctttccttcgtcttcactttggataacctgatgacactgtgcctaggcagagatctttttgtgttgaatttcccaggtgttctttgtgcttcttgtgtatgcatgtctaggtctttagcaaggccagggaagttttcctcaattattcccctaaatatgttttgcaagcttttagaattgtcttctccctcaggaacaccaattattcttaggtttggtcatccgagctctgaatttctttcttctacttgttcaattctattgctgagactttccagagcatttcatatttctaaaagtgtgtccactttctttgagctctaaatttctttcttctccttgttcaattctgttgctgagacttaccagagcatttcacatttctaaaagtgtgtccaaagtttcctgaatttttggttttttctttaagctatctatttcactgaatatttctccctttacttcttgtatcatttttctgatttccttgcattgggcttcgcctttctctggtccctctctgattagcataataactaacctcctgaattctttttcaggtaaatcagggatttctttttggtttagatccattgctggtgaagtagtgtgatttttgggggggtgttgacgagccttgttttattatattaccacagttggttttctggttccttcttatttgggtaggctctgtcagagggattgtctagggctgaagagtgttgttcagatttttttgtcccacagggtgttccctatgtattacgcttcccccttttcctgtggatgttgcttcctgtgagcctaactgcagtgattattgtctgtcttctgggtccagccacccagtgagtctacttggctccgggctggtgctgggagttgtctgcacagagtgcttatgtgaactgtctgtggctctctcagccgtggataccagtgcctgttctggtggaggtggtggaggatgcagtggactccgtgggactccttagctttgatggtttaatgctctatttttgtgctggttggcctcctgccaggaggtggtgctttccagaaagcatcagctgtagtagtgtgtggagagggaccagccatggtgagggccctagaactctcaagattatatgtcttttgtcttccgataccagggtggatagagaaggaccaccaggtgggggcggggctaggtgtgtctgaggtcaggctctccttgggtgggtcttgctgtggctgctgtgggggacggggatgagattcccaggtcactggagtagtgtacctaggaggattatggctgcctgtgctgagtcatgcaggttgtcagggaagtgggggaaagccagcagtcacaggcctcacccaactcccccacaaaccaaagggccagtctcactgtgtcccccgaccccctcaaacgcctgcaacatcccccgagtctgtttccaggtatagggcccagctatgaaagaagacctccccagctgcgaaagaaaacggctttagttcttcccccacctgtggagtctgcaagcccaattcatgcccaccccccaccccccacgcccagttctggcaaggaagcttctcgtcctgttcaagttgttacaaagttcatctagagaagtaattctccctgtggagttttaacccctgctcctctggccaccctcctgatggatccctgtggtgccaggcagggatgggatccttggggatcccacgagctcccagtgtctttctgctacttcctctacccatgtatttcactgggctcggctctctaacttgactcagccccaggtaaagtcgggagcttctcccgcaaagactttcagcttctccagtgggggtgtgtgttcgggagaggagggtctccctttcccacttccacagttgggtcactcacagtatttggggtgtctcccagctcctgcagcagcagtctgctttcttcagagggtcctctaaggattgctggtctgttcttgcagttgatctatagctaaaattcacaatgcaagcctccacatgctgctgtgtctggagctgcaatctagtcctgcctcccatctgccatggtcctcaactcctatttccttgcttttttacatattctgcaccttgatatctgcatatctggtataacgatcacttcttccgattttttgaatttgctttcatatctatgatggtggttgggtaggcactttggctttgattctgggtatgtgcagtagtgtaatctctatagacttttttttggccgaaaacagtatctgtggtatctgtaatttccttggtggcttagggtgcagttgttcgtggaggctgtggtaaagttttgttgtgaacggggacaccaaatggaccagtcgttaggttgcaggatgctagcagtaggctgagcatgcctgtccttgggccccagggctgtatacactggcatcagtggtagcaggtcaagccaggccaattattgggcttctagatggcttgctcaggtgctgagaatggtgacagtgggttgggtgggtgagtaggttttcaagccactgggcagcaaacatgggcaatggcagtagtagtagtgggacaaccctctgggatccaagcagccagtggtggtgttggcggtggctataatgggctgcgtgggccagtccccagacttgcaggtggcatatgagggtgggtgccagctgtgatggtaatggcaggttgattgggcccatactctaggaggagtgctcaggtgccaatggtggtgtcctgggcagggcagtccccaggtccctggaccaatgtgcttggttactggtggagatgcagcaaggctgggcagacctgcccccgggttcccaaggtgttgtgtgcagtgctggctgttgtaggcaggggtgggatgatttcccaggccaccagcagaatgcttaggttggggcagtagcagctgcattgtagctctgctactagggagggtgggtttgctttcagtgggttgctcttgcagatggtgaatgtcagtggggctctagggatgtggagatgcaggggctgttgggccccagagcaagatgcaggaccactagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaagctatgtatggaaatgtcagaccttcacataaagttagcaaagagagaagcttgagaaagttttattatttcacatgatatagttctcaaatgttatattggtttggctttttctgttgaggaggtcaagatgaattattacagcacaaagcaaattacctatgtgcttcatttttatctactcctagtttttttgcttcatttctaagcaataattattatatcaataattattctaggtatgttaagagaaatgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgccttcagatgactctcccaccttggcctcccaaagtgttgggattacaggtgtgagtcactgcacccagcctaaatgattgcctatttttaataccttcaatatacctactattcttgtaggaatatcagactttaaactagtataattttataaataggaatgcttaatttatgtggaaaattgcaataaaagcagaactaaaggttaaaatgtgttaatgttaaaataataggtaaaatgtgtactttttgtgtctatttttaccgagaacaattattaaatgatctccctaaattcagtaactgataggaatgtgggtactttttgtaagaaaatttttattgcagtgttcattctgattaagtgaaaattattgtatttagttgctgctatacataatttttattaatattccttaagtgttgttttatcaggtgatttctctttgccagttgatacaatacaaatggaatataatgcatctaacatttcaaattcaagacatgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggttcggttttgttgaaaattaatgaaagaaaaaagtcttagagggcaataattgtttaatgttttggggaaaattatttaatattgaaaattttgtttacaatttttaaaaatcatttgcaacttttttttagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaaaactatatctattccattgctcagtcagtacctgttattcaaatattaccctcagactatttcaacaagtagccctaaaaatatttgtggggacatgtgaagatgctatatattcctttctgcatttatctatccatattttaggaagaagagcctctgaatattcattcattcagcaaggaaaggtaagtatgcatcagattaattccgcagctacttaatgctttctatgtgggacaaaaaagggattcaagatctggacagcatcatatggtatatgtagagaacaatcagaaagggtgtggcttccaggtgagggttagaggtttaagggatagtgtggcactttagcaggagcttgaaggcccaagttggactgggcctaggcaggaatgtagataacatttacttttatctctagacttaactaagtgattttgatattccaggtatgtcattagcagaataggcattctgctttgggaggagggatggctgggggctgtgaatgggaagaaatgactgataaggacaatgagaaattcagtcagttaatgagagatttagaaccattagaatttttattctttgtgcatgaaccagctggtttagttgtctcagaatggggctctaaaaacaagtttcattcaaatggtgagtacattattgtatggtgaattatctaaggagaaacagtaggctcagattaaccaagccagcactgttcctcaggatctaggaattaaatttctcccttgtgctacagtacacataccatagctagtgctagtaaaaacataaatgaataccattctcttccccggttttatggaacaatattatagagttcaggcttctatgcatacattcccaaaggtgttacaggtacatttagaataaagtgaaatgggccaggcatgtggctcacgcctgtaatcccagcactttgggaggccgaggcaggtggatccacctgaggtcaggagttcaagaccagcctggccaacttggtgaaccccgtctctactaaaaatacagaaactagctgggcactgtggcgtgcgcctgtaatcccagctacttgggaggctgaagcaggagagttgcagtgagctgagatcgcgccactgcactccagcctgggcaacagagcgagacttcatctcataaataaagtgaaatgtgattaaagagatatacttaatctaaatacacaattttttactattttttttttaaataggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacactgccgtctttgagtagttctttccagtacgaaatcatcagacagttctaaaattaagacaagtttattgagtaaaaaaatgcatacattggaacggcaaaacatcaataaggccctaaaacaaaaaatacagttatgctttaacaaattcttagcaatgtggcccacgctttttaaaaaattgacgtgttggcagtgtttgttagaacattgacgtacatcccaaatagtaataaattcagtatgaaattatacgcataaccttactcaccatactactttttctcccaaactattgtgacttctttttgctctctgattaaaacaaacaggtaacatccttacacctttgctccatcccttgggctttaaaaagaatggctgtagttagttttgattcactatatactctctgtacttgaggaagagtaagctgtgtttaaaagtgcccttttccatgtcgtcatgtaccaataccctctgcatttcaaaatgttgactcagatgtttttccctctacagaactagaaaattgtccccccactttggtctatttactcatttgaagacaaacagggttactaagagttttacataagttatttctttagagtgacgaagtgttagtttacttcttgcttagtggagacaaaaattgtgagataaagaggaaggaataggatgtacacatttacccatcaatatagcacccagtgttatttcagcaggacccttctgttagcatctaaggtaaggttaggacagtcaagataaaatactggatgttggccaggagcagtggctcaagcctgtaatcccagcactttgggaggctgaggcaggcagatcatgaggtcaggagatcaagaccatcctggctaacacagtgaaaccctgtctctactaaaaatacaaaaagttagttagttagttagccaggcgtggtggtgggtgcctgtagtcccagccattcgggaggttgaggcaggagaatggtgtgaacctgggaggcagagcttgcagtgagattgcaccactgtactccagcttgggcgacagagcgagactccatctccaaaaaaaaacaaaacaacaacaacaaaaaaaaaacactgtatgttaagggagactccttcagtatctaagagcacttgggggtggactgggggagaagggatgacttcatttacccccatagttatggagtcttgagttctaagaaaattttcatccctattgatttttatgctaaaaacagaatcttacaaatgtgatagctatatatccaaatgaggtggtctagtacaagcatttctgaaaaaatttttgaatgacaaaattttatcctaagcgatatgttttccaagtgaatataattctagtttaacacaacattgcaagtcaggtgtgcacattttactaacaaacatatatcaatgtgatttcagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaaaaaaaaaaaaaaaaaaaccggttcttctgctctgtcaccacctgggtattgaagccctataaaaacactttctacttaccttaatatagtctggcgttgctgggacctcacagtgttctttcacactttttatgtaacttaggaactgaaataccactcatgcatttgttctaaagtgccaaagttctgtctaacttattaacacgtctagacccataactccataacttttactgaaataacacaaattcagtttaggctccttctctaaatcctgacatttatttgcactatgacatttatttgtagaaattgcaattttcaaaaacatttttaaaagttagcattagtaacaagttagtaattagtattagaggcagtagttaggaatagatacgggtttgaaagctatctccactgtatctgtctagtatagcattaatgtgttcaacaaatggtaattactactaagaccacctcaaaaatatattcccattatacttccattttgctaaaactaatttaaaaatcaaattgttcaacgcctttgataaacagaagcctatcttttgaaataaaaaatttaatttcattaaatcaaggattgcgcaggtactgaaaattatccaatactctcaaaaagttaccagaattttagcaataggcagtttttacatgactaagcctagagataaaaaatgtgtcctatgtacatagtttattatctaaatgaaactgcactgttagataaatcttgaggtatcgagccaaaatcctgtaaatattaacactgctattactgacttatacctgtgtaaacacagtatacaaaagcctacatcaaaataattcacttcaacaaaagtactttatatcaggtgacattagagaaaaagaagtaaagcctttgctgtttaccgtcctcctgcaagcatctgattttacacataaaacaggcttcaatttgaagcctaagtacaggtaacatacaaaaagtaaaacttagaagtgccaacatgagataattcaagtacaatatatgttaaaaatatatatttatttcaatttttagatgcttcaactgttacaggccatcatgatttaaataaaagaaaaaacatttgagaaagaacaagaaccttttgtttagagaatgaaatataaattgttaataaacaaagtccacaacaatctcttaaaaaaaaagttactacagttatttctcttgtgaatatggcctggaagaatcacttttcccccaacttaagggaggtggagatttatctctatccaagctttcagtataagcagataagaagtaattctcattttcttgagactgacttgatgaaagggcatatggtgtccccaaaaatgtctgatgagtgagaacattaaaatgactaaactgatgggacatatttaattgactatgataaacctgaaagttactatatgaatcttgttctgttgaattgctgttctctccttcagagcatactatatcaatagaagttctctcttcagaatcaaggtaagtcttatcttctaataaactgttttgcacatcaggagacgattgcaactcaatttgagtattctttttttgatctgttccacgtgatcctttggtctctttctcccatatttctgaatgaaaattgctgcatacttctatatgtgagatttcatcccctgaatccagagacatatcctcttcatccttttcatcgttttctaaaagagctacatttaaaaaacaaaaagtcctcctctattgaaatacacagtttgtttaagttttaaaattatacactactcacacaatataacgcgtcagggtctgcaagtccacaatcccttaaagcttggtcttctgccacaagttcacttagtcacaacactcacactagatgtgaatgtccagataatccgatgctaaaagcttctgcgaaatgtgttcacgtttaatgttgggaaatcccaactcccagctccaaaggggttaatgtcaaaacagcatctaaagttatacggtaattcagtatttgacaagacaaatataaaataaaattttttgacatctagcttcactggattactaaactagttggttagcactaaatgaatgatcatttctgctttttttcatcaaaaacaaaagtacatctttcattttacacagaacctggaaccaaagcagaggccatctcacaaaagattaaagctatgacagctctactatcttgcaattaaattgctttatgcatgtggggaaatctagtagctcaatgctaaatcgccatatctggtttcctacctttttattaatataacccctttgctgacaatagtaaccaataatgcttacaaaaacctcaaagacaaaatgcatactccatagtatgcactgtctacaatataggtagaaatgcataatctataataacttacaacttacactggctacagtataataaatgagcagatcttgtgcatgctaagtattagaatgataaatgtcttgaaacactttccctatggctgtttatactgaggtacgtggtttcaaaatggtcatttcattatttggtaacagcaaaaccattcctctttttctgtctgcgttaaagaaaatgaaaaccactgaaaagttacctgactgcgactcaagattctcattagcaccaagctgtggaaggttttcttctgtgattgaattgtgatagcccacaagatttttaaagttttgcatgaagtcttcagcagttgcaaccactattccattatctgtataactggaaagcatcttgatgttcttctctaaattaagaaaaaaagtttcatgtatgaaacacttcaaaatatagacagcccctagccctcacaaaatcttttccttcacattttcagaatcaaagcttagcaatacccaccacagccccataaaatcctttcattcacattcctatattcatagtagaaagcttaggagtgctctctttacctgttaaaaagactatgtgtcgttgctgtatgttctgagcctgaagtctgataaggcaatccaattctggagcatttcgagtttgtgaatcacaattgtggtatgacaaaatttcaaccagatgtttcttctgatagacattcagaagcgtcaacagacttagagctttagcattcaatctgtgaaattaagcagttcagtttctggatctgtacttctaaaatttagtatggaaatttctgctttagattaaaattcaatttctccactgaggcaactaatgacaactgcactgctttagctctctgcctgatgtagggggtgtgcttctttggaaagaaagaaagaagggataagtccaggggtttcttggtcgcgaggcctcagggccagctatacagcttaggctaaaatctcagctgattattctacttactaaataataaattatgattacctttattaattttgaactttaatgaaggacttaaagggacaaaaacagtataaatccttccttcaaaaaacacaatatatggaccaggcctggtggctcacacctgtaatcccaaaactttgggaggccaaagcagttggatcacctgagatcaggagttcgagaccagcctggccaacatggtgaaaccccatctctactcaaaattcacaattagccggatgaggtggctcatgcctgtaatccgaactacttgggaggctgaggcagaagaatcacttgaacccaggaggcagaggttgcagtgagctgagactgctctattacactccagtctgggcaacaagaacgaaactctgtcttaaaaaataaaattaaatacactattatggctctaagctatttcttttttttttttgagacagagtctcactctgtcgccgattctcctgcctcagcttcccgagtagctgggactacaggtgtatgccaccacacccagctaatttttgtatttttagtacagatggggtttcaccatgttggacaggatactctcaatctcctgaccttgtgatccacccgcctcagcctcccaatgtgctgggattacaggcgtaagccaccgtgcccggccagctctaagctgtttctatattgcaagggacaaggcaacaagtggagataagcttttaaaagtgaattgctacaatgaattaaatactcaaaaattatttaagccttaatttcctgaacagtgtaccatggaatgtcgtattttaagaaatttttgtggtataaagtttaaggaaataatgattgacacaatgtaaattcttttaactagagttcttcatatcctttaatgtgtaaatacattttatagactttactagtagaatatagtgtcccaaacatgcctgattaccataatcatttatggaatctctcaattgactagtgttccaaagatcacacttggagaagtgacttccatgcattttagaaattatctatgtatacatgaattgatgtcctactcacaaatcacttcaccaggtcaagattaatccttgtccaaatatatgtaattttattagctacctataaagtagtcagttgggagagggcctgatgtagttggcacatacagttcagttaaaaaaggaaaatgctggccaggcacagtggctcacacctgtaatcccagcactttgggaggccgaggcaggtggatcacctgaagacaggagttcgagaccagccgggccaacacggtgaaaccccatctctactaaaaatacaaaaattagctgggcatggtggcgggcgcctgtaatctcagctacttgagaggctgaggtaggagaattgcttgaacccaggaggtggaggttgcagtgaggcgagatcgtcccattgcactccagcctgggctacaaaagcaaaactctatctcaaaaaaaaaaagaaaaaaatgctgatcattccatttggatgattactctaaatccacaaatggcaaagattaaaccaattttacctatgcacataacaacttcagcaaacttctactgaaaaatactgcttcttataaaggctagaataattcagtatctatactcaattatggctggctatggacatctgtgaaaaatgaacatccataatctacaaacatgggaagagagaaatattatgagtacaatgttaaaatcaacaaccattatatagttatgtttcaaagcttacctgcctagttcctttagtttcttctgaaatttacagtggactttccattgccattttccttctggagtactaagttcctcaaggaatgtcaaaaaatttttaaggttctctgttagagataatgaagtttgtttttaattcaataaataatcattccataagtgaattatgaaagaagtgttttttcatattatgtagaaacacctactttcctatgtactattttcatttctctttgtctaagggagacagatctatacatgcctaaagctctaataatataacatctacacataaaaaagaacatgttgatgacagtaatacaagaagtgattcaactgcagcaggggcagacagccttgctttacaccacatttagaggatattattggtctaagagaaggagaaagaaatttgaggtaataaaagctcaagaaaagactgaaatgtactagttatctgtgaatggcagaataaatggacagtacattaaaaagtatgagagtcagaagaggagttacgtgctcaaaagaacatcatcttaccaactgtgacaacctctgggtttagaattgattcatcagatacgataaaacctccagatacaaataattcattgtatgtatgatttttaacatcatccaggctatcaacaccagcaaaactaacacaggggagcttctttaaagtcaccaagccaggtatctgtttaaatcccaaaacaaaaagagaaacagatggagggaatgaattgacagactcaagtgtgaaggaacctacaagaagtctaacagaatgcattatggctcatctatattagtggattacctctggaaagccacacaaataatattcccaacattatttcccaatatataaaccaacatttatgtactgggacctaccacagacgactaaggaaaaggagcttacaatagacctgaaaacacaaaatggacaaaagctgacctctctataacctgtgagtacagtcagaattcagacgaaggcaaaagcctatgtgctcgaacagtcaatcaggaaagacgtccaagatgtaggatggagatagggctcctaagactagatgggatacctcaaaatttaagggaaaaggggactggtctggcaaagatggagcacaaataggtttttcctaggacatacaaatgaagatgaaaacattatgtagtcagtcagcagacccaatggcattcaaggattcagtactcttattagtcttgactacctgagtgacagggaagatctgtgatgtgcagcaatttaaaattttgcataggtacaaacttgaatctcacaagctgattcacagatgggtccttaagtttaatctcctttaaagcttattttaaaaacactagtctggcagacagtaagattttaaaataagggagtttttaaaaccaaagtagtgaatttgacttaatagtctaccttgtgaatgaaacctgcaatgtcttcattttgaataataatcaatagtttatctaattttgatcttctttccaaaaactgttcaggatgacattctgtattgcctaatttgataagatattcctgttaaagaaaaacaactaaatcaatattaaaatacttctttgtaaacatcaatttaacaccagaaatgcaagataaactgataagcttaactactaccatgacattattaacaatgaatgaacttacactctaagagaccatcaaatcctttttttttttctttgagacagggtctcaccattgcccaggctggagtatagcagcatgatcacagctcactgcagccttgacctcccaggctcaagccaccctcccacctcagcctcctgaatacatggatggcactaggctcgcaccaccataccaggctaatttttttttttttttttttttttgtaagagacagagtcttgctgtgttgcccaagctggtcttaaattcctgggctcgagtgatcctcctgccttggccgcccaaagtgctgggattacaggcgtgagccactgcacatggcccaaatccacttttcttttctagaagaggaatctaaaggtcagagcttcaccaatcacatagtcacaatgttacagagcttcaccaatcacacagtcacaatgttacagcactatgcaaagccagccaagtaacagtgtgagttaacagaaagaactgttaattaggccaggttcttaacccagctcctttagttattatagaggttaatgattagactctaggttgactataatatcctatgagaaacactttaaggcaacctagagtctaatcattaaccactccctagctcaccttttcctttccattctaagtaggcccttggttatttgcagcagtattaactgggataaacgccttcagagttaagaactttcacaaccatagctctaattcacaacagctaaaaaagcatttatatagagcttcattatgtacaatggtattcacatacaaattagccatttctgtcaagtttctgtcttcaaagtagactttcccaactagtaactcttcctccatgctggtgaacatggtactgcctttcacaggacacaggcagactttcatgcagagttccctttgctctctgcttgctggtggaatcctgaacactgaagcaaactgcaggatcctggaggtcatattcctcatttcagagattacttttaatgtcagcacagctggtcagacagctataataaaaacccagcttacctgacaaccagtctgctgctctttcaacctgaagtgttaccccaaagaggatgctgttgtgctaaagcagcaccttctacactgattttgatccaatctctggaacttttgggcagatctcagaccagcttagtcagttaatgaaaaggtaaattaccatctgacatgcctgctggtaattttttttttttttgagatggagtctcgctctgtcacccaggctgcagtgcagtggcgctatctcggctcactgcaagctctgcctcctgggttcacaccattctcctgcctcagcctcccaagtagctgggactacaggcacccaccaccatgcctggctaattttttgtatttttagtagagacggggtttcaccatgtcaatcaggatggtcccaatctcctgacctcgtgatctgcccgcctcagcctccctgctggtaatctttgatgtcttcttacattaagaagctttaagctcattttaaataagacagtttaattcacataataaatcagtttgactccagaaatatataaagtttacatttttattcataaagtcttttactgtagtatttttgctggaatatttccaatggatactgattaaaagaattaaagtttcaatctggttttctatcagattcgtaaaacaaagaatgctcttttattctatataaatgacagaaatgacttattctatgccagataaattaaaagcacaattaattaggaaatgcatctcctatccccttaatctaaatgtaacggctgggtgcgatggctcacgcctgtaatcccagtactttgggaggccaaggcgggcacatcacctaaggtcaggagttcgagaccagcctggccaacatggtgaaaccctgtctctactaaaaatacaaaaaattagctgggagtggtggcgggtgcctgcaatcccagctatttgggaggatgaggcaggagaattgcttgaccccagaaggcggaggttgcagtgagccaagatagtgccattacactccaccctgggcaacaagagcaaaactccgtctcaataaataaataaattttttaaaatgtcaaataggtatgtgttacaaatccttttaaaaaaaggagcgggggggtggggggtggggggtgcggggatggaggaagttggagttatgctaagcacaccgggaactgtgcccaacctattctctcatctaaccccaaaccaatatgcagctagctatgcccccaaagagtactgtgctagggaacttgttgctggctggtggggaaaagttgagaaactctacattcagtcatgtagggcaaaaatgcaaccaaggaattcctagaagtcttatttcattttcccaagaaaccattagcaatcagtaaggaaagcccaacacagtactctgactcatgtaatttctatgttcttcaggtcttgaccaggtaacatcacacaaaacatgctgacctcagagatccccaaacttacagaaggcttaggacatgttagtagctataaagcccatggtccctctgcttcctctaatgaaattccagtcatggtaagtaaactccataaatgagagcaggcatttatttcaaaatcctaggcattcccttgaggaattaaaatcccataatttatgattaattttactattataccactaatgtaattgctccaatgtgttaccatttacctacctactggtaacaaacttacgtatctatgtctaaacatacagacacacagaaaggcgtgtgtgtgtgtgtctgtgtttttttgtttttttttttttttttgagatggagtcttgctctgtcgcccaggctggagtgcactggcgtgatctcggctcactgcaagctccgcctcccggattcaccccattctcctgcctcagcctcctgagtagctgggactacaggcgcctgcccccatgcccggctaattttttgtactttagtacagacggggttttcaccatgttagccaggatggtctcaatctcctgaactcgtgatccacccgtcttggcctcccaaagtgctgggattacaggcgtgagccaccacgcccagccatctgtgtgtgtgtttaaaccaactatctaaaatattagtctgcagcttcggtagaaaaaatacacctcacaatgagaaatctttcatgactgaggagtctttcaagattatcaagtttcttgatcaataaaggctaaagggaatgttacatggctagggtatcaagaaacaccaaaagtttatcattaggccaaccctgggcagtttgtttttctatatgattgatcaaatcccatgagataaaccctggcaacttaacttttcctctctgtttttttccctcctcttcattaaaaatgcaagaaacggccaggcgcagtggcccacgcctgtaatctcagcactttgggaggctgaggtggacggatcacgaggccaggagttccagaccagcctgatcaacatggtgaaaccccacctctactaaaaatacaaaaaaaaattagccaggcatggtgtggcacgcctgtaatcccagctacctcggaggctgaggcaggagaatcgcttgaacttgggaggcagaggttgcagtgagccgagatcacgccactgcactccagcctgggcgacagaaggagactctgtctcaaaaaaaaaaacaaaaatccaagaaatacttaaaaccttcaaatcaagtttaaaaggtatgtgcataaatgacactataaaacaagattctaaattctaacatagatcagaagttctgaatttacttggacttaccactcttttattccaccctgagttaaattatgaaaatacacaattaacatttatttttagagacagggtctgactctattacctaggctggcacaatcatagctaactgtaatcttgaatgcctgggctcaagtgatcctcccacttgagcttcccaagcagctgggactacagtagagtgccaccacacctaatttttgttattaatttaagagacaatgtcttgttatgttgcccaggcttgtcatgaactcctggcctcaagcaatcctcctgcctcagcctcccaagttttgggattacaggtattagccaccattcctggcctaacatttaaacacaaaacatttaaatacaaaaaacttccattttatagaggtcacaccaacaagagaagtttgtacagcattactattaccttctggtttagttacctttatttctttacagagcacactctcttcttcttcatgaatataaaatttcacagtatttttctggacgtctttcatgattttaaccaaactattaaatacttcaggttctaactggcttataaaatttgaaagagctggttgagcagaaatgtttacatcactgggggattttgttgtttcttctactggttcccgggccatatcaccaggtacaatatgatcagaagtcaccattaactctgtggcatgttgaggctggttcatttctacttcagttaaagccgaagtggaatgctgctcatcagagttggtatctttcaaaggatcactacacagtggctcaaggagatgtttattgttgaagtcacttgaggaaactggtatgacatgcctttccagaggattcgatgctatcttagcaccagaatcgttaggactgactggtggcaaattcccacccttggctgatgctttaataataatagtatttagcttctcatgcaaaccatctacaaactcctgcacaccagctttggaagtcttagaatatatgaactcggaaagccgtttcatcttctcttgtgttgaaaagataggtgtggaaactgtactgacatatgaaacattcttttgcttcaaaatctcttctatcttcctagaaaagagattgtactctcctaacactgtcctctctgtggtttcgctcactgcaggcggctctgcctctgctgctggcacacactgctcctccacctgacctgtcaacacgtcatcctcagtggtgccctttagtgtgtctgtaaatggagaggatggaaactggtaatcagaacttctctgtctatttattacccgggggtcgttaggaaaggcctcctgtggtggcacacacaccagttgttcttctggtgatttcatacctatacaggaagagttcattattataagagcaatccaaaaagataagatatgaaaacacaaacccttaaattgggggaaaaaagggttaacacacatttagaactaattatatattagaaggtaaaataaaatcctaaaattctggtatgaattctattccctatgtgccctacttatgggatggtccttagagttgtagctagtgttaacaactctgctattttgaagcgctcaagcaagcaccaatttggcatcaatacaaattaagtcatttgcttgtttctgcctccctaccattctgtagatctaagtttaatacacattttaaatcaagacagtcaattacatcagcttgctcaatccctgtatttattatttgccaagtaatatctactatggtaatggccccttagtaagaattctgagtgtaaggcaattgtaagaataccaaacagaaatgctgtgggaataactgccaagttaaaagttgcatctaggatctaggataattaattttatctgctttcagacttgttctcacttacgaggttgctaagtagatttcctgtaatgtcagggacttcattttatcaggaaataaaaggaacaataataagacaagagaagaacatatttcacagctgcacatttttgacagtcctttcataaatattttccttttgtttggaaataattctaaaagaaaagatagctatacctcatttgagatacagatgttagctgatactaaggttagctgatactaatgagattaaaacctttcactcttgacaaacagctcaatccaaaagatcatactttccccaaaaaaatcctaaattcaaacacagtatgtttttgaaactacatttgaaaaagggaactctaattccatttttaagcaacaaggggaaaaatatatttaacttcaattttagtgttatattttaggaaaggacaaaaactcatgatctttgcttagaagacgtatacacaattttacccgctaaaaaattactgtttttctttaagccttggccaacattccctaacaaattgctgctgtagtataggaaatggtgcctctaaatcagaaagtccaggtacaggtagttttcaaacttacagtgaagattttgctcacactcatcacacttttctaaaggtttaaatagcctcactaggagtcgagcttatgacattctctaccaatcctggtggttatcatgaaccagtacactcattaactattgcaaaggcaatttgtcagcacagtgaaaagacccaaggcgggtctgtaggcggaggtgagaggggaacaaaatatccaacgtgccaggataagaattagaactgtatgaaattgataaaccagaaaatccaagtttcataagataattaggagtactaaatatcctgagtatcttaaatctccaacattaaaatgtgctttagtacacataaagtgtctggaaggatacacgagaaattggtaaccatggctaatatatggggaagaatctaagtgttccgggctggggcagtattactttcttaagtatttttggacttcttgaattacgtatcatgtcaaatatctgatatattcaaagaaaaaaaattgaattgcatctcataaaacatatgggttgcgaagaactaccttaatttaaaaaattctgaattatttattagacatggggcctcactatgtttcccagactggccctgaatttctggcctcaattcctcctgcctcagtcttccaagtagatgggattacaggtacataccaccacacccagctatttattactttaaatgcaacagtggctcccaaaatgtatagctaaacaacaaccagtaagtttactcctcaagggttataaataaagggaatatttttaacctgaaatataaattaaatccacatggagaattttccataattaaaaacctctaaaccaaatagatccctttataaaatataaataatcacaacctaattttattttgcacaaatttccctgtatgattttattaagaacttaactgctcaggcacagtggctcatgcctgtaatcccagcactttgggaggccaaggcaggcagatcacctgaggtcaggagttcgagaccagcctggccaacatggtgaaacctcgtctctactaaaaaaaaaaatacaaaaattagccaggcgtggtggcgagcacctgtaatctcagctactcaggaagcagaggctgcagtgagccaagattgcaccactgcactccagcctgcctgggcaacagagcaagattctgttgcaaaaaaaaatagaaaaaaaaaacaaaacttaattattttgaaaatatcttcatctataagtgattgaaaacacacatacatgtcaatccataataaagcttttgttgttggtggtggtggtggtgttgttgttgttgttgttgagacagagactcgctctgccaccaggctggagtgcagtggtgagatctcggctcactgcaacctccacctcccaggttcaaacaattctcctgcctcagcctcccgagtagctgcgactacaggctcaagccaccatgctcagctaatttttttatttttagtagacagggttttaccatgttggccaggatggtctcgatgtcttgacctcctgatccgcacaccttggcctcccaaagtgctgggattacaaacatgagacaccgtgcttttttaaaaaaaaacttattgccattaaataattgcagtattttaacttttaagtgaaaggggagtagtcagttctctaaaggcaccatcattcagatgtctacactttagcttacaaaatataaagatggtatttccaaataagaggaatgcaggtgctgatggaacattctgaagcataagaaagataactactagccgggcacagtggctcacacctgtaatcccaacactttgggaggccaaggtgggcagatcacgaggtcaagagattgagaccatcctggccaacatggtaaaaccccgaaatcagaaaagaattactgatagatgcaaaacatggactccctgacacgatattgcatgaaagtaccaaacacgagagacgacatgagtaggctctatttatcctaagttcaacaacaggcaaaactaatcagattagcacttacttgggaacaaggagagtactaactaggagaatgtggaagaaaatcttctgggatgctagaaacgttctacatcttgatttgggtgatggtcatgtacatatgtaaaatttcaaaaagctgtacaataaagatctgtggccaggttcagtggctcacttgaggtcaggagttcgagactagcctggccgacaaggtgaaaccctgtctctactaaaactacaaaaatcagccgggtgcggtggcacatgcctgtaatcccagctacttgggaggctgaggcaggagaatcgcttaacccaggaggcagaggttgcagtgaaccaagatcatgccattgcactccagcctgggtgacagagagagattctgtatcagaggggaaaaaaaaaaagatttgtgaactttcctctatgttatatatctgttgttcatggtttctttttttttttaaccacattttcctagaaggagatggtgaagattttcttcaaggaaactagtaactttaattagcgggggaggggaactcccaaaggaaataaataactacaaagatgtagtcatttcacatttcttacaaataaaaaaacaacactttaatttctgaaaagagtcagatacaacaaaactgaaggaaaatataaaaaagatcaccaccaaactgtaaacaagaaaacaatgcctatgaccatctgcagagaagttgaatccaccaagatcagacaaagattatctcctaggtacccactgccaactagctaatcaataatatctgcaactgtttctgaaatccaagtttcttaatcttatttaatctacctgcagaaattagttttacaatcagaagaactaggttaaaagactatgaatagtatacctaaaatataaatggcttacccttcttggctattttttaaaaatttaaaaaagaagaaacccaggtttgggggctcaagcctgtaatcccagcactttgggaggctgaagcaggtggatcacctgaggtcaggagtttgagaccagcctggcaaacatggtgaaatcccgtctctactaaaaataaaaaaataagctgggcatggtggcatgcgcctgtaatcccagctacttgggaggctgaggaaggtgaattgcttgaacctcgggaggcagaggttgcagtgagccaaggtcacgccactgcactccagcctgggtgacagagcaagcttccatctcaaaaaaaccaaaaacaaaaaaagaagagtttatcataaaatatactgcacaaatggcttaggaatatattctggtcttcccaaatcatattgtaagatagactctactatgggtgaagaaaatttatataaatattcggtgacttatctgaacactctttatagtaagaatagtggatacaactcaagtaatgatttacatataaataaatatggtactgtccaaattttctgtaattaaaaaaatttaagtcaatgccctattgatggagtatcagaaatgcaagtagcaactctgaagaagggcacactgggaagaaaagcaaagcaagccttctcacctggtgtttgtttctcaccatgtttccccagctggtcttctgggcttcttgcattccctcctgagggaaagcatccattagactctcttcagacattagtgatacctacactaagcacctttcagacaaccccaagtgataacaatgcaagcattccttcttctgcctaaaataatctgaagggtcatactggtgatgatggaatatcaacacttaagacattgtaccttcaaatgacccaacaccaagtatgaaggtgtctaaatgagaaacggttaggataaccttcttatatcaactacttcttttgtttctcctactcaagctgatgtttccacctcataaaacaatactaggttccctctatcatcacctacaggcctcctaccctccagaaagatgttaagtagaagatggtgctaaagcccatgggaactcatcaagttttataaattcttctcagagtcctcggaagtctcagcaggttctagtttagttcacaggccagtctactttgtaacaaaaagttgtttgctgttgctattgtttttaaaaggttagaggtgtaggactggaaaagacgtataccctgaaaatatttccaaaaatgtttagctagaaaagtgagtaacaacttggaatattaagagtatgtatttatgtgtgtgtatgtatgtgtttgcacagagaaattagaatgctaccaaaaaaaaaaaaagataatatttcaacatctgctaaactttttgcctcacagttcaataacatttacatttgatcattcaggccattctctaagataatccaatttatttaagataatccagtattaagaaatcaaatttctaatagatgaacctcaacattatcacttattagatgacagcttgttacggtgaagtttaaagtttgagaagacagcatttaattggttgtccaaagagcaccattttatctctgcagctacctcaccttatcaaaaactcagtttctgccaacagtcttcattcagcagtctgcatgctaaactccatagagacagtgtgtcttaaatccctgtttttaaggtgattttgcaggtgcttgctgatgctgaccaagaacagcaacactcagtgatgaacactgtattactcaaaataagacactgaagatgtcagcaccaattaagatgaagcacctagtgacccaagagtgaaatccacagaagatggaaacattcaggaaactggtctctaagtaaaatgaagcaaacacaagtccaagtatacttttcttacctgtaattggaatcagtttccaatgtatttcagtctcttcaacattatttgacttagactgttgtctacgaaatccatgttcaatgggaacactgggacacaaactgcaatcttcaaaattattcacgctaattaaatttggatcctaaaaatcaaagtacacactgaatagctttatttccaattcattttaatgtcaagaataaactgttttttcactgaaaattcacgtgcttcaatctaaacattacaaatgcgtaaaatcaacatggtaaagttatactctagtttcaaaattaaaacatcttttccctcgaaacataattttatgttaatttagaacagggattggtaaacgtttgtgctgaagtgccaaacattaaatattttaggctctgcaggccagactctctagtctatcacaggcaatacctaaacaaatggacacagctgtactccaataaaactttagttataaaaatgggtagtgtgctaggttcaacccatgcccccgccccccatcaacttgatttaaaatacaaaagatatcagaaaatattaatacaggttagttcctcagtgcctaccttacataccccaataaccctcctgccatcatcttccccttgaaataaatatcccaaaacgacatcgagaaagaatggggacatgcatacaacttttaaacaaaggcagggaagagaaaatggagacagtaaatgaagaaataagcccataggaatacggtgcaatcctagaactattccccagtgatgcagtgactgcttaaggcagataaggctacttctcagctacaaaccagcactctgaacatatatcataaatatactggacactctaataagcaaggctgagagtcacttcaggggtaatcctaaaggctgcttatgttccattcctatttgcgtaagaaataccaagtacctaactgtcacactgctgtactgagactggcatcctcatctgcctcacctttgggttctctgttactgccgacagaaagccaatgctttaataattcaacttcattatgaaacaataaggaattaactcccaataagccatttctgacaaatattaatagattgttccgcctaagctttatcacaagtaaactgtagacaatatattaagcttctaagaaggaaggaaaactacttcagcatttatctctttgtaacaaggaataacttaggaagtaccatcctagacaggcacctttactcaaaagtgcattttatttctttttcaaagaaaaaaatcattccctgaagcatactcacagcacctctttcacacacacactcacaaacacaaaggtaaccaacagctatatgcttacttctttcaaatgtagcttatggtcagtgcccacttcgctggtagaaatagcaacagaatacttagatgttgcatcaacttctagtaataagctctgagtacccttaaactgtgcattttcaacttttgcacaagtaggctgctcatagtctttcttatctggggtagagttcaactcatactcatgtttttgcctcagctcttcataggcatcatcagtgctcaatcctaaggctttgttgactgtgtctgtcagagatgcatcagaatggcgcgcatttgctagtgtttctgataaccaattaaacagcctatggatgtcagcaatgccggagttacaggtatcctgctgctgccgcctcaagtcagcatcatgtccaagtgagccaataggctgtggagactctgagaaaaaggaagtcattggttgaagttaagtttaaaagcaagcataaaacttttaaaatcaaatatacctaaaaaattatcataaagcatttatggtcaggaactcaaccaatttgcttagactttacaaatattcgcatcactttacaaaaagaattgtaaaattttgcacatagttcaaaattgctattaaagtttaatttccattgtaatttaagcattctatcaataggaaaataagctcatgcattaggttttaaatatgtgtattaataactaccatcaaaatctcaaagtcaaccaggtgcttgacaagagatgaaacatttgtaattactattttgccaattgttaggattatatgtgtattacactaggctactaaaaaaatgacaatttgatttctatcttttccatacctattatattttgtccttaaggcattggctgacacacttaaaatctacaccttatcttgaatgactagattacttaaattcataatgaagctagggtattatagagataaaatcaccctgaagaaatctccacgaaatttgcatcaagaacaaaaagtattataagaggaaacacgttaagacatggtttcatgcatgcactataaatctgtataatctgtaacaatcaatatattttaaaacttgtaaagggcgcaaacattcagaaagtcatgtgctttaatattggggtggggtagggattgggtgaagcctgagttaggatttcaaatttaagagtataatgtaccacaacaaaaataaatgtcagaaacaaaggagtgcatactgtatgactctaattatgtaaactttttatagagcaggcaaaactaatctataaagacaaaaagcagatcagtagtggagtggggtgagctacctaacaaagaacacaaagcaacatataaaaatgttctggccaggcacggtggctcatgcctataatcccagcactttggcaggctgaggtgggcagatcacaaggtcaggagatcgagaccatcctggctaacaaggtgaaaccccgtctctactaaaaaaatacaaaaaattcgctgggcgtagtggcatgaacctgtagtcccagctacttgggaggctgaggcaggagaatcacttgaacccaggaggcggaggttgcggtgagccgagatcatgccactgcactccagcctgggcaacagagcgagactccatcaccaaaaaaaaaaattctataggctcacgcctgtaatctcagcactttggaaggctgaggagggtggatcacctgaagtcaggagttcgaaactagctcagccaacatggtgaaaccctgtctctactaaaaatacaaaaattagctgggtatggtggcacacgcctgtaatcccagctactcggaaggctgagataggagaatcgcttaacccaggaggcagaggttgcaatgagccgagatcgggtcactgcactccagcctggaagacagagtaagactccatcttaaaaaaaaaaaaaagttctatatattggagcggtgattacacagctgtcaaaactaatcatactgtgtgcttaaataggtacactgatataaactgtacctcaaaacagtttatgttaaaagttacaaggggtggtgggaatgggttaggaggttacctcataaaatgactgggctcaccaccaaatcaagatcagggtgttttaaaagttagaatatggctgggcatggtggctcacgcctgtaatcccagcactttgggaggccgaggcgggcggatcacaaggtcaggagatcgagaccatcctggctaacacggtgaaaccccgtctctgctaaaaacacaaacaagtaaccaggcatggtggcgggcgccccagctactcgggaggctgaggcaagagaatggcgagaaccagggaggcggagcttgcagtgagccgagattgtgccactgcactccagcctgggcgacagagcgagactccgtctcaaaaaaaaaaaaaacaaaaaaaaaagttagaatacaaccttgaaatctctaccttcagaaacaaagtatgcaaaattacttaaaaagaaataagtaagaaacacctaaaaatgcaagtctgatagtcactagttttagttaagcattctacccttcttcctctgctccatttctcatttggtttattataattagtatggctttctcatcattttaattattgatgaagcctgatttttacccacaactattttttcacatacacagaattagttaccaacaaaaacagtaccaaaaaataagtatcttatttattgagtgcatataatgtgctcagtgacaggaaatgcagcagtttgttgtcaacaatgctttggagtcagtcagaactgacttcggattgtgccactaacttcataacttttggtaaagttatttaacttatctgagatgattttctcatctgcaaaattaggataataatgcctatcactcaagaactattaataaatgagttcatatacataaagtacctagcacatagtaaacagagctctcaagacatgtcacaagataagacagtatgtgtcagtaagtgctaacaggttcagcacagattgcaaatccagcataaactagaggagaccattaaggagaatagacagaaagctgaggagaatatgaactgcaaagatataaggcttgaaagaaatggaagctacttcaggaaaaaaaagagggaaataaaagactgaccatgacatactctaggcagagagagatgacccttaaccaagacatgtgagagaacagtgggaaacatggctggacatggctagtctataacaaagccttaaaaagcaagtatataagatgagattggtagcaaattagcaaagcaatactgagaagaacatgatactgaaacgggtgcaagaaggtagtaagtcaggaaggccaccaaagagataaagaacacagacaaagagtaacaacattgcaaagagaaagagacacacaggttaactaaagaaaaaatcattatagttactgcaaagaaaagtaatgtcaaatagaactttctgcaataatggaaatgttctctctctgtactaatacaatggtgtggttgttgaaatgtattttaatttcattttaattcaaacttaaataaaaacatatggctagtggctaccacattgaataccataacaataaaagaagtaaaaggagagcaggctgagcatggtggctgacgactgtaatcccagcactttgggaggccgaggcagacagatcacttgaggtcaggagttcaagaccagcctggccaacatggcaaaaccccgtctccactaaagatacaaaaattagccaggcacagtagtacgtgcctgtaattccagctactggggagactcaggcacgagaatcttttgaaccaggtaggcagaggttgcagtgagccaagactgagccactgcactacagcctgggtgacggagtgagattttgtctcaaaaataaataaataaataaaaagagcaggaaagtgaaaagtgaggatacaaatacagattgctaagagcaaaagtgtaaaaagacactgatctgactaacctagactaagacactgatctgactaacctagactaagacacactgaatctgaagagacaagttgcttaataaaaagcataagaatattcagttctgccataatcagaggagcaacagtaacacaaaacgtggattgttatgtcaactttctatgaatgcaaaagaactcattctgtgcttatcaactagtagtgtgaagatcttaaaaatctagataaaagtgttttagctgacttgcaatattgaaacaaacacacttaaaacaagcgccttacatgtctatctttttctgtcaactaaaacaaaacaaaggaaaaaagaacaacaaaaaaagaaaaacccaaagatattcctggattcttggggtagaaaagagtatgtgtatgcatattttattttcaaattcagaaggttccttttcattatgcaacagcctaaaagatactactattctgatattatacttcttcaactataaaaataaaggaatatggccaggcgtggtggctcacgcctgtaatcccagcactttgggaggccgaggcaggcggatcacgaggtcaggagatcgagaccatcctggctcacatggtgaaaccccgtctctactaaaaatacaaaaaattagccgggcatggtggcaggcgcctgcagtcccagctactcgggaggctgaggcaggagaatggcatgaacccaggaggtggagcttgcagtgagccgagatcatgccactacactccagccttggggagacatcaagactccgtctcaaaaaaaataaaggaatataaaaggacaagagttctgattagtattattatgtcatgttaacctaaaccaaacaatttagaaatctgatgtaccagggcaggaattgtaaagtgtttcctgtactgggccaggtagcaaatattttaggctttgtgggccatacagtctcagtgccaactctgccatgacagcatgagagcagctacatacacataaataaatgggcatggctgtattcaaatacaactttctttacaaaaatagtggacaggctgaatttgaccctcaggctttaatttatacgcccctctgctacaagaaagaacagaactactttatttttggctgttataagagcaatctgatattttaccttcatacagatggcaattttcagataaattactggttttggcgagctttctcatattttcaggtagatcctcaagcttcctcttcaagacagttttgcttctcatatcttctgtgtctgagtccccacccacactctttttcctacactgaattaaattaatcaattctttgactctatccttatcataatccaaagaatgagatgatctttgctttccagatataatggcttcacctcttgagttatttcgttttccaaatttcatttttgtaccattcatttcttcttcttgaccttcataatctgaaagtggactaaactgctgaagttttctattttcttcaaatagttcttttaatttacaaataggtaactgatacacttcaggccgaaaaatataggcatgcaaacaagtatcaatatgggatttatttctgggagctgagtataagaattttttatcatctaatcgtgaatcatatggaaacataataaactctcgtttacctgaaccaaaacctcgcttaaaaaattcacttacatacttttcaacaacagaatgaaaatttatggcgcttatatttttgaattcctttcgacactgaatcaaagaaaattgtaaaaactgagctatttttaatacatctggcatgctctcatgcctctcctgtggtgctgcattggttgaacctttttgtgctgtaaataaaacaaacaaacaaaaaagcaaaccatgttagcaatcaagaaactaatcaaatacagatctaaatattgccaaagaagtataaaaacatttatacattaatgttgaaccagacgagtatgtaccctagtacatatatacaatatagcaaatatatgaatagcatgcttgtaaagtccaggatcctaaaacaggccaataagaaactaaaacaaatgaaaaagcagaacacatttttaaaggaaaaatcacccactcattgaagatctcacttcctactgcccccaggaaattcaaatagtggcaagcaatatgtaagaagaaacagagacagaacaagatctgaggctccaagcaaaacagtcctgcatgtcatctcttcctcttataaagtagtaactaacttcacatgaacagatatgtagatgctgagtagccacaactgagaaactcatccttaatccaacagtgaaataaagccattagtgggaactttagcttaatacacagtattaaagttcattcttagaaaaggtggttaacaaatcttgtcttatatcagtgccaaaaattctcattaattttgaattgcctaatatttatcctggcaaatgatgctttagagttactaaaatttgaatgcaaaattgaactaagctaaaaaataatcatacaaaaccctcacagaccgggaatagtggctcatgcctctaatcccagcagcttgggaggctgaggtagttggatcgcttcaggccaggagttcaagaacaacctagacaatatagtgagatcctgcttctaaagaaaaaaaaaaaatttaaacttagctagctgtgctggcgcacgcctgtaatcccaagctactcaagaggctgaggcaggaggatcacttgagcctaggagggagggcaaggctgtatgtagtgagccatgatcgcaccactgcctgggcaacagagtgagactctatctccaacagagtgagactctatctctaaaataaataaaaagtaaccatcataactaagctacagtactataacaattataatcaagctttatgagagcactgataaacacaaattaatttttcatagttaaaaaaaatcgtcagccaggcacagtggctcatgcctgtaatcccagcactttgggagaccgaggcaggaggatcacttgaggtcaggagttcgagaccagcctggccaacatggtgaaaccccgtctctactaaaaatacaaaaaaattagctgggagtggtggtagatgccttgtaatcccagctactcaggaggctgaggcaggagaatcacttgaacctgggaggtggaggtcgcagtgagctgagatcgcgcccctgcactccagcctgggcaagaagagcaaaactctgtatcaaaaaaaaaaaaaaaaaaaaaaaaaaaaaattcatataatttgtgtcttatattgctaatacctcttaacccccagtatttcctgaaacatgaggtaagaaagacaaaatgtttagtgagttatctggaaaatttcaatgaaatgttaagtatctataagtaaccagatttagatattcaaagaacttacaagtaactatgcttctaggttcttgaaatagaaacaaagcatgtaggactcgagacttggcagtctgatattctaaaaaacagaagccaaactcattagcaatgtgttttaactaaaaagttaagaaagaattgtaaaaatttattaaagagagaccacctaccatatggaggaaccatctgataaggggagagaagaaaaaggtatcctcggtctcccaaaggtttaacaagaacctgtattttgaggggaaggaagaagttgtatctgctttattattattcaccataaggcagacacacagcattttctactaattgtaaagaaaaaaagttcttaatcatcttttaagaaaaaatattgctaatgaattagttaattctttctaccaactctgctgattaacaggattccaatcaaataaaaattccttggttttcataacattaatgagaaaatgttactgaaagaactcccctaactgcaaaaccacgttaatttttccctgaagctaaaatacaaggaccaagctaaagacttcaattttcttcatcagttcaaaagacatgtttattaatggccaaggtaatgtgctagatgctagatacaaaacatgctttgaaacactgcgttgcaagagttcagactaatcacaaacccaatgtgttgccataatctaactgcacacatattacatgaacacttttcacatgtaagggaatttgcccagagatatccaaatacaagcaacacaagatccttgatcacgagaagtttataattaggtagaaagagtaccacaataaataccagtaattacataagacagaaaagttccctaagagatttacaaaataacagaaatggaaaaatacagtttgtttacggtagtaaaagatggtcaagaaaggtttactgaaagtgtatcaaaagtggattttgaagaatgggtacactgacaagagcctgagattgtaggaaggacatttcagtagaggcaacaccatgagcaaaggtgagttgtaatggacagtttacaaacatcacaatatttatcactggcaacagggtgaggacagactaggataaatgtataagacaagtcgggaatgaaagatcatgggttagctgtaaaaagaccagaagccaggctggccaggaatgtccttgagagcatatccctttgagctactgtttccttaaaacaacagtaagaaagaagacttgacagcacagtgcaggacgcagaaaaacaatctaatgcaaagaatttatttcaggggctactgcaatagttcacaatgttttgggtaaatgagaaactgagcatggcaactgaacacaaaaggatatctgagctctgaaagaaaactcgtactacctaaattcctactaaaacaattccagtaaacaacgcctgtataaaaactaataattcagaggacaaaaagtaactgtgctactaattcacatttaataaaaacattgtttgcacactcaaaagtaaagtggtattgtgtttgggggtttcaggtagcttagttgaccactttctccagggtcaacttctccttcagttcaatctgtgccaaaaatgagtcttagatacctggtactcaaggaggttattttagtggaagcaggctggtggtatgggacagataaagtcatggggtcagatgaccaaatgactaggtccatctgaagaccattctaaactttggggaatctttccccatttttactgcctggattccatgagggtcagttatcaggtctttcttttataaaggaagttcaaatattcttgtaagggtaaactttgttgtaaggtttctaatagttaatctgtgctgaggtggccttgtttcctaaaaatcccagggccaaggttaaaaatcctcaggccaagttacatcatactgctgacatatagtattggccctgcaagatatttaactgggtcttacggctaccatttatagccacgctaagtctcttagagtatactacaagcggacaatgtacctgaaaattttgtttcaaatacttttatccaaagtattttagataatatacttcttttaatattttgttcaaactcctagttgatgaaataaaaagttacgaagcacaagattttcatgttttgtgctcactgacgaaaaccaattagatgcctttaacctctcactcactccaaatactaggttttataaattccactaccagtaacctaaagattcctgtattttaagggggcccaatgtttccagaaatccatggagtacaagcaatctatgatcagaaacaacactaaggctgacagaggcttcagcagttatatctgtggcttcagcccaatgaaatccattcaactctgcagaaaagaaaaatcctgcaaattgtgctcctgttgtctctattttagctgtttggttattcttaaaaaaaaaaaaagatattaatccaatctctggggtttttaaattagtttattctactattttaaatttccagataacattaaaggtattatagcactcccccacccccacaaaaaaagagttagtataaatacatgtacaatgggccaggcgcagtggctcatgcctgtaatctcagcactttgggaagtcgaagtgggaggaggattgcttgaagccaggagttgaagaccaaccttggcaacacagcaagaccccaactctacaaaaaaaattttaaaagttgtcatgtgtggcgtcatatgcctatagtcctggctacttggaaagctaaggtgggagaattgcctgatcctgagagttcaagctgtgaagctgtgattgtgccacgcactatagcacctcagcctaggcaacagagagtcctgtctcaaaaaaaaaaagcttagaaggaaataagctacactaaagtgagattcagcagaaaaaaaaagattcaaacactcaaaggcatcaaaaattggaattatcagatgcaaaaaggaaaataatccactatgaaatctttaaagacataaaataattggaagaattaaaaacattttcaagcaaaaatgtttacgctaatgttcatagcaccattattcatagtagccaagaaatagaaataactgataaaagaacaaacaaaatgtggtattatctacacaatgaaagcatactgggccataaaacagaatgaagttctgatatatgctacaacatcaatgagccttgaaaattatgcttagtgaaagaagccaggcaccgaacgccacatattcttgactctatttatataaaatgttcagagcagataaatccatagagacagaagtagattaatggctgttagggattaggaagggggaatgtacagtgaattctgagatgaaaatgttcgggaattagatagtgttgatgttgcacaacagtgtgaatctacttttaaaaaaaacatagaattatatactttaaaatggctaaaatggctgggcacggtggtgcacacctgtaatcccagcactctgggaggccaagttcaagaacagcccaggcaatatggcaaaaccctgtctctacaaaacatacaaaaatcaggcaggtgtggtggtacgcacctgtagccccagctacccaggaggatgaggtaagaggatcactggaccccagaaagtcgagggtgcagtgagccaggatcacaccactgcactccagcctggatgacaaagcaagaccctgcctatttaaaaaaaaaaaaaaaatggctaaaatggttaattttatgttatgtgaattttatttcacttaaaaaatataggcaaagaataccggaatataatgtgcacctcctagaactctgcctggcgtatgataggtactcactaaatacttctgaaagacttaacaagaacctgctataaaataaccaggcagatccaaaaaaattcaaatgtaacttttaaaaataaaaaacattccctgtgaaattaaaaacacaataaataaataaagcaacaaataagacacagctaaatacaggatttttaaactagaagatagttatgatgaagttacttagaatgcagcacagagaaacaaatagatggaaaacatagacaaggttaacagacgtggaaaatatgcctcttcagagtcctaaaaagacaggccaggccgggcgcagtggctcacgcctgtaatcccagcactttgggaggccgaggccagtggatcacctgaggtcaggagttcacaaccactggccaacatggcgaaaccctgtctctactaaatacacgaaaattagccaggtgtggtggcacacacctacaaccccagctactcgggaggctgaaacaggagaactgcttgaacccgggaggtggaggttgcagtcagccaagatcatgccactgcacaccagcctgggcaacagagtgagactccatctcaaaaaaaaaaaaaaaaaaaaaaaaaaagaaaagacaagctaaagaaaatgagggagaagtacaataaaagagataactaattttccagaaaaaaagacacaaatccacagatatgaaaggaaaagatataccaagctggataaatagaaatctacacctagatactgtaactgctaaacatcaaagaccaaaaaaaaaaaagatttaaaaagtagccagggggcggcaggggacctacaaaggaacaattagactgagagctaacccctaaacaaaaatagaagccataagacactgcagcatagtcaaagtgcaagaaaatagctgtcaacccagaattgtgtacccagcacccaatgattatagattatacatttttctcaaacacagaaggagcatgtacaaaaattgaccacacagtagatcttagtctcaacaaatttcaaataatcaccaccattgttgattacaatgcaattaaattagaaataaaaaagacaaaagtatccctgtttccctatacacatacctctacatcatatatcaaagttaaaaaaaaattggaaactaaaaaataaaaatttcttagaaatgaataatgaaaatactgcacattaaaacgtgaaatgcaactaaagcactacttacaactgagtatttattgactatttttctgacttaaagacagaaatagcaaaacaagtctcaaaaaagtaaaagttggccaggcttggtgactcaccctggtaatcccagcactacgggaggccgaggcaggcagatcacttgagcccaggagtttgagaccaatctgggcaacatgatgaaaccctgtctctactaaaaatacaaaaattagccaggtgtcatggagcatgcctgtaatcccagctacttgggaggctgaggcaggagaatcccttgaacccgggaggcagaggttgcagtgagctgagattgtgccactgcactctggcctgggagacaagagcgaaactctgtctcaaaaaaaaaaggcagagatggtataagaaaggaaaatttcaggtcaatctcattcatcatcacagatacaaaattcctaaacaaaagccaaaccccacaatttactttaaaagctgtggcaggggtgggcggggttggggggtggtagtttctatacaagcaatgcaggggtagtttaatattggaaaactataaatataactcaccttagtaggtctacagaataaataccatgtgtgatggttaattttttaggtcaactagatttggccagggagtgcccaggtatttgatcaaatatttttctgggtgttcctgtcaagctattttcggatgagtttacaaccaacagactgagtaaagcaagccaacctccctaatgcaggttggccatatccaatcagctgaaggcctaaagagaatgaaaggcaaaccctaacccccacaacaaaagaattcctcctgtctgtcttccaagttgggatgtcaactgttccctgccttcagacttgaactgaaacattggctcttcctgagtcttgagcctgccagccttagaactataccactggcagtcctggttcttgcacctgcatactcagactgaaactgtaccattggctctcctgggtctccagcttgttaactgcagatatgatcttgggacatgtcagcctccataaatgtgtgagccaattctttacaataaatctctttttacataccacccccaccataaactattggttctgtttctctgcagaacccaaaaatactgtgtgaccagattgataaatgcaacccctgacccaaaacaaaaaccatctgctaaaattcaaaatccattcatggttaaaaaaataaagaagcaaagtttaaaacataaaaaactactgtggacttcctacttaatggtaaaatgttataaggcttttttttctttaaatcaagaaggcaagaatgcccaaaatcaccatttttattcaacttcttagtacagatcctagactgcacattaacatggaaaaagaagtagtatatagtagttcccttttatctgcagaagatatattacaagacccccagtgaatgtctgaaatcacagatagtaacaaaccctatgttttttcttatgtatacatacctataataaagtttaacttttaaattaggcatactaagagactaacgacaataattaataataaaatagaacaggctgggcatggtggttcatgcctataataccagcactttgggaggtggaggcatgagggttgcttaaggccaggagtttgagacaagcctgggcaacacagtaagaccctattctctattaaaaattttaaaaaatagataaattttaaaaactagctgggcatggtggtatacacctgcagcccagctacccaggaggctgaggtgggagaatcacttaaaagacaagtagttcaaggctgcagtagctatgatcacatcacaccactgtactccagcctgggcaacagaatgaaatcctgtcctcccaccaaaaaaatagagtaactgcaacaatatataataataagggttatgtaatgtggtctctctctctctcaaaatcttattgtaatgtactcacccttcttatgatgacgtgagatgatgaaatgcctatgtgatgagatggaagtgaggctgatgacatagacattgtgatgcagcattaggctactactgaaaactaatttaaaacttattaattatttctggagctttccatttagtattttcagacaacagctgaccacaggtaactgaaactacagaaagcaaaaccaaggataacaggggactactataaagatgagaagaaaaaaataaaaccaatctaccttccagataatgaattctatatagaaacccccaaaaatgtacaaaaataaacacttcattcaaatttcacattgatctgcattaaatcaatatgtaagtatcaattacatttctatatatacaagaaacagaaaatgtactaacatggaaaatactattcacgggccaggcatggcggttcacacctgtaatcccagcactttgggaggttgaggcaggcagatcacttgaggtcaagagttcaagaccagcctggccaacatggcaaaaccccatctctacaaaaaatacaaaaaaaattagccaggtatggtgttgcacgcctgtagtcccagctactcaggaggctgaggcaggagaattccttgaacctgggaggcggaggttgcagtgagctgagatcacaccactgcattccagcctgggtgacagagcgagactctgtcccccgcccccccccaaaaaaagaaagaaaatactatttacaaaagcatcaaaaaatgtaagacagctggggataaatctaacaaaaaatgagcaagactagtatccagaaaattctaaaactctattaaaagaatacactaggctgggcgcagtggctcacacctgtaatcccagcactttgggaggtcgaggcaggcagatgatgaggtcaggagttcgagaccagcctgaccaacatggaggaagtcccatctctactaaaaatacacaattaaccaggcatggtggagcatgcctgtaatcccagctactctggaggctgatgcaggagaactgcttgaacccaggaggaggaggttgcggtgagccgagattgcaccattgcactccaacctgggcaacaagagcgaaacaccgtcaaaaaaaaaaaaaagaatacactaaagaaagggcgagatggccaggcacggtggctcacgcctgtaatctcagcactttcagaggccaaggcaggcagatcatgaggtcaagagttcaagaccagcctggcctacatggtgaaaccccatctctactaagaatacaaaaattagccgagcatggtggcaggcgcctgtaatcccagctactccggagactgaggcaagggaatcacttgaactcaggaggcagagattgcagtgagccgagatcacgccactgcactccagcccagcaacagagcaaggctctgtctcgaaaaaaaaaaaaaaaaaagtcaatataatcttatttcgtgtatcatctccctgggtgaaaagaaaacttccctggatttctacgtgccactgcaaaaagtcctagccttctaatatacaaaaatgtatatgatataaagataagggaatgtttgctttcatatcccccacaaatattttactcttcgcataccttaagatttagatctgtagtcatttatctagttaattgctctgctccacaataataaaacttattttatctccctgagagcatcaagtggggtagattaagagattacagcaaagagaggttcctaggttaagtccagaggtgccaagaagactatggagatctccctaagcatttacatttcaatacagaatgagtttccaggaatttggaaatgtctcttggtccaagagggctaaacaaatggctcctgaagcgattttatttatataccaaagagttggagttaatattcataacatttcaaagagacacattcaggatagcagggaatagctgcctcttcccttttataagcaaatagaaagtatttgtccccatcttttacctatgtagtatgcagctactcaggacaagtggcttaggcctgcatgccctagggagttaaggactaaggcaaaggagggccaatacatttttacttactgtggggtattcacaaaatctgtctctgattcagaaaaccttgtgtgcatttcttggacaaaatttaaaaatcagtattcctcaatgcactgctcattatcaagaaaactatgaataaagtagctatagacggaataatcccagtgaggcctgctggaaaacggatagctacacaaaattcctaggtacattagattctgggagtgtatccttgtagaatgctagcaacctttaagatctaggattttactttacttcttgattctggaaaagatccagtcttccattaacataatgtaatacttggtcaggtgaggaacgaaatgccatctttcctatcctgatcctcatatcagtaaccgaaagatattgtaattttctgataaacccctcattgtccgaattctcaatactcactctctgaaacacaagaaccaaatagatttgtgtaactcagtatctctccatatccaaacctactatctcaactttcactttctgaacttgggaactgaatagattttgatgatgaggaatgcttgcattgtagtcaggctttcagaagaaaacaagccatgtaatacaaacataaaattatgttcatatgcagtgagaaagtaagaaggaagggccaggcgcggtggctcacccaacactttgggaggccgaggcgggtggatcacttgaggtcaggagtttgagaccagcctgggcaacatgataaaaccccgtctctactaaaaatacaaaaattagctgggtgtcgtggcacatgcctctaatcccagctactcgagaagctgaggcaggagaatcgcttgaacccggaaggttgaacccggaggttgcagtgagctgagactgtgccactgcgctccagcctgggcgagagagtctgtctcaaaaaaaaaagagagagagacagagagtgagagagagactgtgtgtgtgtgtgtgtgtgtgtgtgtgtgtgtgcacgcgtgtgtgttttaattctaggacatttaattgaaaggtttctagcctgtaagtcaaagactcgcaagggttttataactctgcctggaagttttatgtcaatctgactatcccatctataaacaacagactgattaagcacatatatatgaaaataattaaattctatgtagccattaaacatgaagttgcacgttctgaaactcaaagatatttgactgccattcgactacctggaaactgaggctcaacaaagtgagaagtaaaaagtcaactgttgtaaaacttgtattaaatggcgcacctatgcaaaaaagttgtatccctctttcttggaacttacgaccaccatttagcaagacaaaaagaaaccttggaacagccacttcccttctctccaaccacctcctcgccttcagctaaaccacatatactggcatcacattcattttccattcacttctcaacccaccacaatctgatgtttgacccaatccctctacccaaactagatatgcttcagtattaaattggaccttacctcagaaatatcccataaatctgtctcttcttgtatcattaccttgtcatcccacccgccatcaccctctaatgtaatagtttctacctcatctcccctcaatttattctcgagtaactaacgtaattattcaaaacacagatcttatgttgcatacactttcaaagtttcaatgcacacccttgaaaatccttcaaaatctgctgctcttaggatcaaatccaaatttccaaacacttgaacactgcctgaatgacgctgtatgacacaggtccctactactttcccccaactactctagtgttcctttatctcctcaacctcactgagtttattgttcttggattttcttttttcttttttttttgagatggagtctcgcttttgtcactcaggctggagcgcaatggtacgatcttggctcaccacaacctcttcctcctgggttcaagcgattctcctgcctcagcctccccagtagctgagattacaccacaccaagctaattttatatttttagtagagacagggtttctccatgttggtcaggatggtcccgatctcctgatcttatgatctgcctgccttggcctcctaaagtgctgggattacaggcgtgagccaccaacgcccggcctgataatcacattcttaatcacaaagtataataaagatattccatgggggctgggcacggtggctcacgcctctaattccagcactttgggaggctgaggcgggcagatcacgaggtcaggagattgagaccatcctggacaacacggtgaaaccccgtctctactaaaaatacaaaaatcagctggctgtggtggtgtgcacatgtaatcccagctactcaggaggctgaggcaggagaattgcttgaacccaggaaggcggagattacagtgagccaagatcacgccactgtactccatcctggtgagacagcaagactccgtctcaaaaaaaaaaaaaaaaaaaagatattccatgggaaagactggtttgcacaagctccaataccatggcccaaataaaagaataccagaaccacagtaaaacactgttaactaaacagcagcaacagacagacacctcatggtactttcagaggcaaaaataaactgaaacactaatatgatcacacatgaatatgcatatttgtaacaaagaatgagaaacattaaaaaacttttcactcacaagtttttctctgtctagtttttgcagtaaactctccatgttacttccaattcttgtcttttccacaacttcataaaggctgcaatacattccattcttcaaaactgacataagaaaaatacatagtaaatatccaaatcaagtctgcttctaatgcatttcaataaaattaaattaccttaccttcatttggacctaagtatgtttccttataaaacagtgctggagggattttctgtttcagatgatcaatactcataactgtttcaacatctaatttctcaggtctgaaagaaaattttaaaaacatgtttgccttatctgtattttcaactctagcaatcttaacacatacacaaaaaagtacacttgatggaaaatagaagagcatatctacgaatatctcaccttattctaaagatcttttgtttcgtttgtgacagtctcactctgtcacctaggctagagtgcagtggtgcgatcacagctcactgcagcttcaacctcctaggatcaagtgattctcccacctcaacctccagggcagctgggactacaggcatgtgccaccacgctagggtaattttggtttttttgggtctttttgtagagacaaggtctccttacgttgctcaggctggtctcaaattcccggtctcaagtgatcctcccacctcagcctcccaaagtgttgggattacatgagtgagccactgtgcccagcagtaaaggggatttgatactggaagtccagatatatacatgggtagatagctagccaggcaatatttccaaccttccatccttaagccagaaactaaaaggctgtcattttattaaggacaactgaagtataaactgttaatcttcacatgtttataaaggcccacaatgatggaagcaagagattttagacctttctataccaacatatgctgcataggactaaaaacagcctatatattttaactcaccaaatcaaagctcttcccaacaaagaactggtaacttttaagtctactatattcaaaatgctacataaaaaaatatatctacttagaataaaactaaaaaattatatttcagacttaaatcactaagaaaaagttttaggctgggcgtggtagctcacgcctgtaatcccaacacttcgtgaggccaaggcgggaggatcatatgaggtcaggagttcgagaccagactgactgacatggcaaaagccccgtctctactaaaaatacaaaaaaaaattagctgggtatggtggcaggaccctgtaatcccagctactcaggaggctgagatgggagaatcgcttgaacccgggaggcgaaggttgcagcgagccgagattgcaccactgcactctagactgagtgacaagagcgaaactccgtctcaaaaaaaaaaaaaaaagataaagttttataccgtaaatgtactgactagcctatcctcaaatcaagacagagacgtagaggactcatattgccaaatcacgtaatttcaaatcaaccatttaaaaaacaaaccaacatttatattgaagttcttatgaaccaaaataaaatttaaatatgaaaaagaaataaggaaaaaggctcaagaaagtgataaaattagcaaccacgaactgctctttacttatacttacagtttgataggcaaaaaagcacgagtggctgacctcagagaaatataacacaaaagttttcctttatttaaaagctgtcctttccacaaggtatagttatatttatctaaataaaaagaatataatgacacagcttagtcacttggcagcccagagaagtgagtgcacatttattagaaatgagacggaaaatatctagaaacaaggtttaagtaggagggcaaaaaaaaaaaaacagtgactcttctacacttctatttactaacagttcaaatattaggatttttgtttcaggtatttatcccctacaaaatcattccagttgcaaagaataacaaatgtatctgtctaaatgtcattatcagaaaagttggggagcaaagacaagataattattcatctcttatttcctccaaagggacactgtatgaaatctggttgattatatgaatgcctacagtgtcctgtatcttctactcattgtgttttcattataaagaaactttaaaataggctgggcatggtggctcacacctgtaaccccagcactttgggaggccgaggcgggtggatcacttaaggttaggagttcgagaccagcctggccaacttggtgaaaccccaactctactaaaaatacaaaaaattagccgggtgtggtggtgggcgcctgtaatcctagctactcaggagaaggctgaggctggagaatcgctggaacccaggaggcagaggttgcagtgagccgagatcacgccactgcaccccagcctgggcgagagtaagactctgtctcagaaaagaaaaaaaaacaaagaaactttaaaatagtttaatgtcaatgctactttcaatcttctctaattctaagtcctacacctctggtgaatttaatacttttaaaaagctgagttatgaaacctgttttattttttatctttttctattaaagtgctaaaacctttcagtctattcacagtagcagattttcaaaggagatcttatgcttggacaaccaaatgcgctgatgctacattataacttttcatactttgcagattttcattcattataaaaataatacaaagcacttaatcttttgctatatgtacttattctttccatttataaaactaaagaaacataaatctcttacctatgtttctatctgtattaaagctgttagatctacaaattttttaaaagaaaagaaaaacattactcattagtataatcataaaaattaacatgtaagatgatataagtgcaatttttaatggcatactacagttaagtccttcctccaggtaggaagaacaaagaaattactcattacaaagtctagtaaatccaagtctacttagagaaaacagaagtacttacttcgctcaaattaccacatttacccaaatttaagggagttgttttttccaaaaatattaaccaagagagaacagtgtccaccaaagtctcttgtcaattattttgctgacattagaagacacagcctcaatatataaatatattaattcatcattcagtaaatacatactaagctcttatttaccaggcacagttctaggtaataggattatagagataaacagaacaaagttccaacctacataaatctaatgaggaagacagaaaacaatgatatataacagatcatgatggttttcagtgctataaaaagagacataagagtatagaggtaaaaaaaaaaaacagagaaacctcaatcataaggaaatacgtgaagaaatgtagaatgaattatgcagcttactggggaaagtgagagaacagcaaatgcagaggccctgaagcaggagcattcatggaatattcaaggtacaaggatggatgttcactcaatgctcctttgaaatgatatagaggtcaagagatggaatcaaagaggaggcaaagaaattaacagtcattattcctgggggcatgacctcataattttaagtgctggatgtcttttaaagagtacttatgaaaacactgtagtgaaagtatgtatcacagtgatcataaatttagagccacaaaaaatgaaagccacaactgtctggatactatgtcaattggtacctgtggctatagatggtttccaaggattattcacctacataaaaggaccgtaaatggaagagaagataatttgatctggaaaactgacaaagaggtcaacctcaaaaatgtacatatatgtttcatgatatatggttttagaacagcagtatttctaaattaatagatatcatacatgacttcaaatatgtatacacacccaaagtaaaaaatgagcagacatttgaccatctcacctacatccctataaatatacttattccatttggctaaagcatttttagaatcaacacatggggaaaaaaaatggtaactgcttcctatttggtcaccttatactagagcttttaagaaatactcagtaacacaagaacagaaaaccaaaaaaaaggaaagaaatcatcaggccaagtgtggcagctcatgcctataatcctagtgctctggaataccaaggcaggagaactgcttgaggccaggagtttgagaccagcctggccaacacagcaagacccatttccatgaaaactaaaaataaaccagacatgatggtgcatgcctgtagtcccagctacttgggaggatcgcttgcacacaggggtttgaggctgcagcaagctatgactgcaccgctttactcactacagcctgggcaacagagcaagactttgtctctaaagaggaaaaaaaaagaaacagagggtcctcaacactggctgaaaatcagaatcacctggaagcttttaaaaactatcaatgccttgactgcccactaaatatttgattggtttgtggtgaggcatgagcatcctttgtagaagctccccatttccaagggtgctaatacacaaaatctcacttttttgttgttgttgttgtttaaatacagacgaagtcttgctctgtcacccaggctgtagtgcagtggtgcgatcacagctcactgccaacctccaccgcccaggttcaagcgattctcttgcttcagcctcccaagtagctaggactacaggcacgtaccaccacatccagctaatttttttgtagttttagtagagacacagtttcaccatgttggccaggctgttcttgaactcctgacctcaggtgatccacccacctcgtcctcccaaagtgctggaattacaggcatgagccactgcgcctggccaaaatctcactttttaaaactgccacttactggccaggtgcggtggctgacgcctgtaatcccagcactttgggaggtcgaggcagtaagatcccgaggtcaggagatcaagaccatcctgggtaacacagtgaaaccccgtctctactaaaaatacaaaaaaattagccaggcatggtggtatgtgcctgtagtcccagctactcgggaggctgaggcagaatggcgtgaacccgggaggcggagcttgcagtgagccgagatcctgccaatgcactccagcctgggggacagagagagactccatctcaaaacaaacaaaacctgccacttactcaactacacaaaccttcatttctaaggaagagattagcgagatgaggtttaaattttagcttgtatttatttccacatggtaaactgtctgttcttcacaccgaccatttaaaagtcattgtaaacacttcagtctccaaccaacttcaagggaagttaaaaaaaaaaaaatgggaaggaaacaaaatggtcctcctaactcagtagtacaggatctgtagtagaattatcactgcggatgatgtctaaaactcctaagtcttaccttgatgaaggtacaaacttcggagtttgtatatcatctttgtaagtaaaagacacaactgcatatggacaaacgtgtcttggtcttcgccttagctcatcaaagccatactcataaaaataatactaaaaataagaaaatgaaaaattaacttctttaaaaaggcaaggtgaaaccttatatttaactgcctgatttctgagaaatagaaaaccatatatgcacttctgacaaaaaatgtctttaagctctgcgtgccaatttaactaaaataattagtactttgtattcattttgtgatataaaatattctgcatctaagtgcgtaagatcccagagtattactaactattccaaaagtttacttctgaagagttgaccaccgggagtttcctaataaaaatattataaacagagcctaagctcccaggtcagctcagaatagccaatctaatacaaaaagcaaaatactaagaacacaatctcaactaaaccaaactatggttttgctatttcaaaagaaaaacacacctgggctccaattgcaaacaaagtagcaaagggagatacggaaaagaatctgaacataggtgacaaagatagccttccctcttcccattacccatcagtctttccccttcacctcttcaccacattcagtatagtacagttttgtaactttcagagtagtgattttcactttaagaatgcctgagtttatgaacaaagtagtacagttcttcaaagtccattcccctgggaaactattgatttcaataatgttgttattgctctaaaaatggctggagtttttaaaaaacgtaaggccagtttgcaagtccttctagaaaagccaataactatcttacatgtatacttcacacctaccaatattgctactgtccagagggtaatcaaatgagtcagtcccaaatgactttggtgaatataatttttgctaaaagcccacaacaatagttcttaaaattttattttacataaataaagcaaaaattaaagaaagaacatttccagggaagttaacattactacttttcacaagcagtctatttggttatagacattttttttaatgttaaaaagaacaggtgccgggtgtggtggctcacagttgtaatcccaacactttgggaggctgaggcagacaggatcacctgaggtcaggagtttgagaccagcctggccaacatggtgaaaccccatctctactaaaaaaaatacaaaaaattagctaggtgaggtggcaggtgcctataatcccagctacttgggaggctgaggcaggagaatcatttgaacctggggggcagaggttgcagtgagccaagatcacaccaccacactccagactggacaacagagcgagactccgtctcaaaacaacaaaatactaataattaaaaaacaagaatagggaggccgaagtgggaagatcacttgagcccaggagttctagaccagcctgggcaaaacagggagacccccatctctatttaaaaagacaaacacaaaaacaaaaaaccattgctttatagtcaaacctcatataaaaacttaacactaaagctcatcaaatgttactcttatataggtgtagtatatgtcaattatacttgaataaggcttaaaaaatagttctaggtttgcatctttaaaaatgttaataaagatagaaaatacctatcaaatcaatagtataaaatgttatgcattaagattatttcaaggggtttcaactttaccttgaaagatgagtagtatcttattaggcaagagatctttctaggccaggaaatgccaaggtttcaaaatgaaatgaggtgtgttgagggcaatgatcatataaaaaccaggtcacagtctactggcaggaagagctagactagggagtctataaatattaccctgtaaccttgaagacccactgcatgtttctgagacatctcagaaaacactgaacaaacagcagcaacagacactggagtctggaagtgatatgcagacaccagagtctagactaatgtggggacagagagaactgaaagggagacattttaaaggatttggtaacaaacaggtatgagatcacaacattacaacggatcctggaacctacctgagtaagctcataggctctgtaagccaaaagtgatgtaattcgattggcattctttgacacgtgacattcatgctttggtgtggggtccaaagcactcttatttaacatagattccaaactttttacacccatggggtcatatatactctttattttaccctaaaatagagaaaaccttttaagtgtctacctaaacctaattgttgactatataacattaatattatgaaatacttctttgaatatagatcaactatcccaaccattttttccctttaatatctcacagaacagctgggcgcggtgactcaggcctgtaatcccagcactttgggaggccaaggcaggcggatcacctgaggtcaggagttcgagaccagcctggccaacatggcgaaaccgtctctactaaaaatacaaaaattagcagtgcatggtggcgcacgcttttaatcccagctactcaggaagctatggcaggcagaactgcttgaacctgggaggcggaggttgcagtgagccaagattgtgccactgcactccagcctgtgtgacagagtgagactccgtctccaaaaaataaataaaataatatctcatagaacacttttaccaaatttgaagcagtaagaaaaagctaatcactaaaagaaaaaaaaaaaatcatttgaacttgtttaataacaagtaaatagaaactccattcataatactcttcactaatataaatcatattaccaacatattactctctacattcctttctttggaaaggaaaacaaactcttaagtacggttagcttagctcaaagatggcaaataggccaggcgcagtggctcatgcctgtaatcccagcactttgggaggctgacgcgggtggatcacgaagtcaggagatcgagaccatcctggctaacacggtgaaaacccgtctctactaaaaatacaaaaaattagccgggcttggtggcgggcacttgtagtcccagctacttgggaggttgaagcaggagaatggcatgaactcgggaggcggagcttgcagtgagccaagatggcgccactgcactccatccagcctgggcaacagagcgagactccatctcaaaaaaccaaaaaacaaaaaacaacacacacacaaaaaaagatggcaaataaaccattttcaaaagtatctttaagtaccaaacactaacaagcatgaacttttaaacaatctcctaaaaacagcatcatctaaaaattaaaatccaaatcaagtgtagtttttcatacatgaagtgtgtaagtttaaattaccttcattattttaaaaataacaacatcacccattgcccccgtgtccaaaggattcgcttgtaataaatcagcatacctagaaagatagacacctagaaaagacggaaaaattaaggaaactgattatatttttcaaaatcactaggactaaaataagacatttttaagaagttatccttcatcaatttgaggtgttcaaaaatcagaaacaaaagataaaactgatcttacatttcagaacctatgactagtctttttctgggaacataataaagcatgaatttaataacaactgcagtgaaattacgagacaatgtatttttagacagcaacttagtagtagatatttatatttaaaaagaaaaaagattacccatggaaggactgccaagaattgttattttggactgacccacatgtaatcctttttcacatatggtttgaacctaaatttaaaaaaaaatacttcatcttgcagtcataacaacatttaaaacatgaaaaaataattttataaacttggtttaaataaaaacaaagcttcttaactatgtatcattctagatcacagaaatcttatatatttgccactttataaatattaatgtaaaactgacttacacttctcaaagtaaccatatctagaatccatttttcttcattttaatttttttagagatagggtctccctctgccctctaggctggagtgcagtggcatgaccttgaactcctgggctcaagtgatcctctcacctcagcctcccaagtaactagaactacaagtgctcaccaccatgcctggctacttttcaatcatttttcttcatgccaggtgtgacagatactcttaactcctgccactcaatatatataaccaattcttttcaaagagaattagaaacagcaaaatattattccacctaaatatcttcgattaaaaggggaaaaaacagaccaggcatggtggctcacgcctgtaataccagcactttgggaggccaaggcaggcagatcacttgaggtcaggagttcaagaccagcctggccaacatggggaaaccccaactctactaaaaacgcaaaaaaattagccgggtgcggtggcgtgtcctgtaatcccagctactcgggaggctgaggcacaagaatcacttgtatctgggagaaggaggttgcagtgagtgagccgcgatcacaccatttaactccagcctgagcaacagagtgagactccatctcaaaaaaaaaaaaaaaaaaaaaaggaaaaatggttccaggcacatagaatcaacaatatagaagataatctcacatataatcaacaatatagaagacagtcttcttaataaagaaaaaaggccaggcgcggtggctcacacctgtaatcccagcactttgggaggccgaggtgggtggatcatgaggtcaggagttcaagaccagcctggcccacatggtgataccccgtctctactaaaaatacaaaaattagccaggtgtgggggggtgtttctgtaaccccatgtacttgggaggctgaggcaggagaatcgcttgaactcaggagacagaggtcgcagtgagccaagatcacgccactgcactccagcctgggtgacagagcaagactccatctcagaaaaaaataaataaataaacagaaaagtattattatcaagcacattctaggggaagaaaataggactggtcagagaaaaaactgagtacatttgaaaaacaaattacaaacaataaacattttgccccattaaatcatgtattccacttatatatcaaaaaagtctgtaattgtaaagaatactgttgaataatcacaaaattagtaacttacaatggaaacatccccaaattgttttttataaaatgcgttaactcacctggtatcgatcaaccatcagaaatgcataggattctgaaagttccttatctaaacgaccatcaaacttcagttctcttcgcttttctgtaaactaaatgaaattaaaactataacaactacttagcatgtgattatgtttttcaagctacaagttttatttttttttccaagaaatctcacacctaccaaaatggaaaaataatctctatctctctatactctctgtccttcagtttttcccctattttaactggctctttatatataatattaatatagtcaaataaacatctaatgctcaccaatctttaaatttatcttataattttaccacattccaactctcccatagattataaattcatgctttaattatctttgtatcttccattttacttaacatggtacactgcatccaacaggtggtttaataaatctgctgaatgaccaacttctagattataaactcaattaggacaagaaaaatgcttcttttctctgtaactgtattctcaatgccaagcacataagatgtgctccatacatatttataggatggaagagtgactttttctaactagttggaactataagttatcctaaaccactggctttcctatctataaaatagatatgcatttaaaatataaaatagctaacattttatattcaggctattactgctctttaataactaatttatcttcagactaaattttcatatgaaattaacaaataatcgctaccataccatgaaaccacatcaattcaaactactaagattttaattttctctgggattcagtgccctttagggaacctttcaaaattaaatcctggtaccacttggttaaccaacttgcaaaaataaaaaattcgtatttcaggtccatcggaaatcattatgcatcaaatatttcaaaacatctatacattctggcttttcctaaatcaaaactcaaatattctaatttgtacatgaaacttaagttcactgtctaacatgctcaattattcttctttgtttgaactttttcactaagaatatgtactaatgataaaatcctaatatagccaccaggcaataattgtggaaaaaatgaagcatgtcctaaaaacaaacacacccatatatttgacttcattaattaccttccaatttaggcatttaattaacatgtacaatactcaaagagcaaaaagccctactaattcacaatttatttatttacttatttatctgagacagagttcttgttctatcacccaggcttgagtgcagtggcgcgatctcagctcactgcaacctcacgggttcaagcaattctcctgcctcaccctcccaagaagctgggattacaggcatgtgccaccacgcctagctaattttcgtagagacgggttttgccacgttggccaggctggtctcaaacccctggcctcaagcgacccgtccacctcggcctcccaaagtgctgggattacaggcatgagccaccatgctcagctgaatttacaattgaaccattagctagtaagctatctctacacttaagattttcagttaaaaagttattttacataattgcatattagtaacaatttaacacagcagataaatgtaatgctacagcaacatctggtggaaaaaagagatgtcatttaaaacttgttttcccaattaggcaggtgcagtggcacatgactgtaatcccagctactttggaggctgaggcaggagaactgcttgaaccagggaggcagaggctgtagtgagccgagatcgcgccactgtactccagcctgggcaacaacagtgaaactccgtctccaaaaaaaaaaaaaaaaaaaaaaaaacttgttttccctttgtaatttggttttcctaaaaattttagtatttctagagaacatttttttcccaggctgttaactggttctgaaaacaatcttacagtaagtataatttaaaacatacctccttttccaaaagctcattgtgtaccaagcaagcacgtctgtagttaaaatttgttactgaggttggttcaaggtaagaagaatggagaatatttacaacatcttcaaattctcgagagcctggagttaatggctggaaaagtgctaaaataaaaaaacaaacatttaaaatgtttaacattactccatcttaaatatagctttttatatttttgtgggttaatgtaactttaaataccatgaaaaaaggcatcaaggctatcttactttgtgatacgcaaaagagatacttattaactcattgaaaaaaaatgtaaaactagttgcctacatacaccagttccttcaacaatgaggatctggcattacatacatagacaaggaaggtgcaattttgcaaaccttaggcatgctatattaggcaacctaaattgcttaaagactcttaaaagaacctgtgtttatactcaacttagctcctattttatgttacactgaagtatgtctcagactgtgtatttcagcaaactacctataccatgtatgagaccataaaagcatttaagacgttatgtgaagtaacaaaatatgctgttactgacacactggtctttaagtttaaaaaaaaaaaaaaaaaaaaaaagcttggtggctcatgcttgtaattccagctctttgggaggccaaggcagcaagactgcttgagctcaggagttccagagcagcctgggcaacacagtgagaccctgtctctacaaaccattaaaaaaaaaaaaaaattagccaggcatggtggtgcatgcctgtagtaccagctacttgggaggctgaggcaggaggatcctttgagcccaggagttcaaggctgcagtgagccacgttctcccaccgcactccagtctgggagtgagagagagaccctgtctcaaaaataaaaataaaaaataaaatgctgcactcacgtggcttcttgtataatccacaaaaagtagtagaacatttattatgacaacttagtaaaatgaaaacatgtggggctttagagtcaaagctggacacaaataccagacctagcattactggcttggagtaaaatgcaggtaaataaattacttatatagctcagctctctcatatgtaaaatggcaaactccagctactctaataaccactatatgccacatgccacactagacaacacgtggaaaaagctctaagcatagcatctgacgcatagtaggacattgtttgttttgagatggagtctcgctctgtcacccaggctggagtgcagtgacacaatcttggctcactgcaagctccgcctccaaggtacacaccattctcctgcctcagcctcccaagtagctgggactacaggcacccaccaccacacccggctaatttttgtgtgtgtgtgtttttagtagagacggggtttcactgtgttagccaggatggtctcgatctcctgacctcgtgatccacctgcctcggcctcccaaagtgctgagattcaggcatgagccaccgtgcccagccaggacatttaagtttttatcctccacatccccaaccattctacatcccactgaattttttttttttttgagatggagtttcgctcttgttgcccaggctgaagtgcagtggcacgattttggttcactgcaacctccgcgcctcccaggttcaagcgattctcctgcctcagtcttccaactagctgggattacagatgcctgctaccacgcccagctaatttttagatttttagtagatatggggtttcaccatgttggccaggctggtctcgaacccctgacctcaggtaatccacctgcctcggcctcccaaagtgctgggattacgggcatgagccaccgtgcccggtccccacttaatttttaaaacatttaaatcaactatgcaattagttcttgagaattactggtctagtaacctcaaatttccatcttatgcacaaaatactttaatttactaatacacctaaaagtctatacatatatatatttccccaaatcaaaaaggaaccacttttcactgtagagagaactactcatagaaactatgttattctctattaccttaatttctttcaagacactatttaataagggtcaagaatgtaacagtcaaaacaggtcactactgaaaacataatgttccacttgtacatactcctaaaggtaacagatgcagcgaaccgttatcttttttatacatgattattagactttaaaagacatgtcaaatgacagagccattcatccattcatttaccaaagcatgtatatattacataagtgtctgtaaaaacgtagttttcaatggcacaatgtgtacaaacaaatggttaccactattttcgaactgtgcacgaaaaaaatagtcaacagttatagcaatacaattaaaaaataaacaggagtaagctcaaacaagtactcaaatagaacaagactactcaacacaaagtgtcctataatcaaacttgtagcagacgaatatgctcggtaacctattgattgtaagctccatgagagcaggaacctgccttgctcattactcgtgtttcccacatcccagtagctagacctgtgagtgccagccctaaatatattaaatagtcaagaaaatgagaaattttgtcaagagctttaaaaatggtaacaatatattctactactaaatgactgtgatttaaaattgactctttcacaaattcaacaattcagtaatatacgaaacacaaatgaaagctcagaaaagagggtagaaggcatatattgtcttcattcaaacctgtgttatggaacgtaggacaaaaacatcttatctttgtgataattgtccccaattaaactgtgaaaaacttggcaaggaaagcagcatgtggaggtctttataggctttcacaaccaaagtgggccaagcatgattttaaaagttgggttatgattttaaaagttgggttttacacgattttgtttctaaacaaaatgacttcagatatataaaatgtacacaaaaaaaggtatcacatggctgccaatttctatgaaatgttagtctacataaaagaaattttcattagttaagctacccaatacaatttctaccattaatctaatcgtaagtaaaaaattagtcaaatcatgaatctgcataaaagttcacatccaaattattctcaaagtacttaacatttccagttgactctaaagcaatgtccaagtcatgtccaatgtactaaaaatgacagctgacaggaaaaaaattattgcaaatgaaaaggaaaaagcattttagctttaacaataaatatctgtatcctaattattttgtattgcaaatgcctcagtggcttcgttaggccggttataatttctcattttttctggtgataatttctaagataataaaattatcctgcaactatttttaaggatttcaagtcaacttgctgctaacagcagttcagaaaatttattaagttcatgttctgaatgtacattttctggtagtctattttatgtcctcagaggtcatttaacactacatgtatctcgatcaatgtatcctgtcactccttttaaagaaaatatttaagtcaaaaatctcaattatgggtcactatttgaggtagtaataataaacaaccctgtgtctatccaaatagggaaagcattatgtatatgaattatccatttcactcagggaactcagtattcaatacactgttctctagattgacagttactgtctaaccattagtggttaagtaccaccttcaatactgtactaagagctttacatatatcatctcaatcatcaaaactacactatgaagttcaacatgcccgtttctcaattgaaactgagacaagtagccttttgagttggcccaaggttacagggttaatgaatgaatcaagctgctgggattcaaattcaagtggttaagctccctttcttgtatcctgaaatatatgatgtgtgtgtgcatatgggtattagacatacaatgtccaatcatgtcaagagctggaaaaatgactgtttcctcactttatagactagaaatcatatacaacacttagacacaggaagttaatataaaagaacaaagaatttcgttctaatactgctctttctaccttcctatcttctctcaaatttcttaattttttctgattttaattttcctctagagacaacagggccaagagtcgtaacaccctttgttttataaaggttaacagcagtagcaatagaagttctttcacacattaagaaatgtgtaattttgcttatttgatcgatttccattaaatgcctgtcagaagaacagctaagttgattactgatcacacaaggtttccctacttacaaattatagatgtattttacgagactgaagagcagatttacaagggcacttagagatttataattcaaacgaggaaactgatagtatcatagaatttcaactggaattcaaatttcctgactcttagccatactatcatcaaatattttttattactagtatcatacaaaacacacttatgattttttttttttttttttttttgagatggagttctgcactgttgcccgggctggagtgcagtggcgcgatcttggctcactgcaacttccacctcctgggttcaagctattctcctgcctcagcctcccgagcagctgggatttcaggcacccaccaccaggcccagctaattttttgtatttttaatagagtcagggtttcaccacgttggccaggctggtctcaaactcctgacctcgtgattcgcccacctcggcctctcaaagtgctgggattacagacatgatccaccatgcccagcccacactcaagatttgaaggttgtatttataaaggcagtgggcattgatatataatttaggtcatcaaacagctttgttccttaatcaaaagaacatcttcatcaattagttttaccaatttgtttggtgttaaggcagatctttttgtattatgtatacatgtatcacaaaaaatattatcatatatacataaatttaaaaaagctaaacttaaaagacatatcattcctatcaaaacatacaaatggggctgggcgtggcggctcatgcctgtaatcccagcactttgggaggccaaggagggcggatcacttcaggtcaggagttccagaccagcctggccaacatggcaaaatcccacctctaaggagaatacaaaaattagctgggcgtggtggcacatgcctgtaatccgaactactgggggaggctaaggaaggagaatcctttgaacctaggatgcagaggctgcagtcagccgggatcgcaacactgcatcccagcctgggcaacagaggctctgactccaaaaaaaaaaaaaaaaaagacatacaaatgggtcatacgaagtacaaataaacaattgtctgatttaaagtaactaatacatagaagatgacgaaataattagcaagaagaggctgaggatctgaaattttctgaattcacagctgacgcctattaatgattataatacaaccactctccatccatttgttcttcacagtaagatctttttttaaaatcacttttcttcattctaaaaaaaattaccacagacaatactttaggagtgggtacttcatctctacatcaacaaggttgaacatagtgtacaattagaaatgaatatgctggcaggaatcaagagtacaaatacgaaacaaagttttttggactgaggatagctcaaagtaaattttaccttgattactttgctattatgtatggagagagctattgttctcagaacccactcatccatatacaactaatgaaataccatggaaatttccttaagaatgagacttggctccaatgacttcaaaaaggcaagtgaaaattttgtgggggaagatggaggttaggagaattagccattacttctggactaaaccagtatggaaatttagtgcatgagcgcaattaatttttgagactcccttggaccctacaaaaacattaaccaataaacgttttccagaaagtgaatcatcgctactccatttcccaagaactttggagggaaaaattacatcaaatgcaattaccaattttaatttactttttatgactcactagatttaaagaaggcaatagtgaaacatctaccaacaaaatgcaattctacaatttggttaaattctataatttggttaaatgtaagaatcatgcctcagccaataaataacatacatcaaaaacagtaaaatgtatacctttccagtcaaagacgcacttagtatgtcagtaccaaccaaatgttgatagtaaacataatttctgaatgtcaaaattccccaaggatgaaaacatactaaatatttctatatttaatgaagggggggaacagtttttgttactaacaggtcaggtcaaaagcagctaacttaaacccttagattattcaaactgggtagcaagatttttcttttttatagtagtaaaagtactctacaactaccttcaaattccatctccacaacttagctgtgtgacctgaagcaagttacctaacttctcagtactttagtctcctcatctgtaaaatgggaatagtacctaccacaaaacattgttgagatttagtcaatgtatgtaaattgcttagaacaatgcccacaacttattaggcactatacaagtgtttgccaatattattactcaattacaatggcagttattttggatgtcacactactgggaagaccaaaaaaagaactttctgagtcaagttgtatttgcatagcagtgacctttaaggtattaaaatatttaagtcctaatcttaaatttcactggaaaagcacagtcacaagaaaaggtctaccatattaaaatatgaatgcaacagaacctgcactgtttttgaatttttttaataaagttgaatttatgtattaaattctatcagcaaccactaacttctctcagcttgaacaagataaaattcatggtggtaaaatagctgcttatttaattttttaaagttctatttaaatcgctattttactatttgaacagctggtgttcagggtataaataattacacaagttaaaaattgctcattttcactaatcatgacaaagtccactgcgatatattttcctcccaacttttgtctgtaagtaaaaatggaaaatacaagttttacccaagaggtacaagactatgggggacaacagctagatttatatttcctaatccctcaattatttccacttttagtgtgttcagctgaagtctattttacaacaatctctggattttatctaattttaaaaaaacacacaaacacagtgcctttccagttcctactgccttcccacatttcaaactaaattttgaagagtttctaggccaatcttctggtcctaacaaacagtaaaaaaaaaaaaaaaaaaatcacggtttgtccatattcttaggcacttaaaccttaaaaatagatttcaaacggcttttatcaagctgtgaagaaaaaaaatagttccacctcctacctcataaccagagcccatttgaatgtacttcctacctattctctaccaattgattacactgggaacttttctcatacagactataatcatacatctcaaattttaactaaatacacgaaaagaactgagttttgacctttaaaagtatctttctgaaccctaaaattacattaactcaaaagatatttctagaaacattcctcatgctaatttccaaaggttaacttcatctttgtcaacatggtttctcacaccaagtattttcttggctttgccatccaaacaaatgaactttatttgtatttttccaataaaaggctcaaacaattccagtagtgcaaatggaactggtgatgcttatggaaagtcagtataatgctacagccaagactctgtaccagatggatggaaaagatacgggaaaaaaacaaatcctatttttttccaaagtaaataatgaaaacctaaccatacagtagggcaaaaaggaagttgtctaaattcagaatatccaaaatttactggatagttaaaaaataataccccaataacaaaaaacgatactaattttgacctccattaggaattctgactccatattaacaatatggcattaagattttttaaaagtacaagtaattaatgtaactgtttccatatgggttccaaaaactaagactggacttttttttaacctgaagttctaccatctagaagaccaagttggtgactcttgagaataaggtaacttctcattagtttttttccattgggaaattactgctccaagaacctacctttccattcttttcaaatataagaaaaacaatactaagttcgaatttaaagagagaaaaacctatttaatctaacgcttcaaaaacaagggggaaaaatctacatggaaatgaagtgtgatggaaaacagcagtgtgcatggatcacatctactaatagagatttctaaataagggaggacgctgacatcaagcacatttcaagtagacacacagaactgaagaatttccacggggagaagcactcatggtcctcagaacattggcaatggccttggagaaagccccagaatccatggccacgggctatttccatagcgagacttctcagaagcatccttaggaggacacaacggcttctctgctttcaggggctgggagggaggggcgccgagcaccatctttcctctctgggagctgcagccttacggacaagcttcaaacctgagctacttccaacttccgcggggaggggcagcaggggagcgtggttccaccgctttctctcgcaccaaacgcggcagctgggcggccgtggcggtgaggggagaggcggccggcgctgcatgcgtgtttacgtatctcggatgggtgtgggaagaggagatagaaagattctaatgaaaagatggaggggagagagagagggggttgagaagaaggggaggcaccacctttcttttctctgctcttcctggggatctgaaaactcctcctaacaggcctttcgggctcttcggggcctctgggcagggcggccgcgcccgcctcagaggagtcctgaggctgctcgtggctgaggctctgggcggcctcggcccccgcgttctcctcacgcccagcgccgccgctgggctcagcgatgttgaggccgccgccgccgccattttgttgggaggactcaagctccggaagcgcctgcttcatctcgtcgtctccgccgccgccactttcccaactcgcatccgtcggctgacaggcctccgtctccacagcagtcgccatcgcgccggcctaaggagctctgggaagcttctgcccacaaggtcgacgggtgtggggggaaggggcggcgggccagtctcgccgccgagctgctctcagcccacccacccccttccccccgtggcctcaggctgcgctcccgacctggcagcctcttggggggccctgtagcgggcaccccaaatgcgctgcccggtcctcggagccgctcctccctcgggcagttcttctgccttcccccgccactcaacgtgcgcgcgtcggggccgggagggggcggggccaccgcgggccactccaccaatgggagcgcggcacccgcctgcgcgagtgcggaaataccgcgccggggggcggagtttcggggcgcccgagcccgccaaaaggggcgaccgcaacgccccgcgaggacctcgacgccgcagccgtggcctgcggaatgcgtgggcccctggcgatcttcgggttcccggggattcccccgccgcgctgcaggcgagggagactagcttggcctcttctccggagcgcaggcgtcgcccatttgtgggcaaaacccttcctctgcgcacgagttatctcggcccaaacgggcttcagagcagtggatgcgggacgatctcggttttatgaactatttgcatgtgtacaaaaacctggagaggagataaaagaatgggctaggcggtaatagcctaaaagcctcgacagcctttgcgacctgctattctcaccggatcttgtatctttatgatagattactcgcacccggccttctcttttatctcagagagtgtgacccagtgtcacagctccagcaagcactttcacctgagatcctctgatgggacttaacaacctagtgttaacaggatttggttctggggagtttgaggggaggaggctgttaacttttcccatttttttcctttagtcgcacccccccccaccacacgccatggagaccgcacctggcctccatttgttccctttctatggttacttctgttaaaaatctggccactgataaacctctaactccactgtttcttccactggaacgttcatcaacgttttcctatagtaaatgtatattaaagaaaaaataaacttgcggtcacattaaaaaatacacagcaggtcgtcgctctcccataaagggaacaacttcatagttaagagccctttacatagtggtttctaccttatcagtataaactatcacgggttatcgtgagtacagccaatatttactgagtgctttctacgtgctagacacggactggacaagtgatttacgtgcattgtctccatttaatcctcacagcaacagacatgaggtagatactagtttgcagaatttgaaagaagcgttgcaagacactggacaaattatggtaaccgaagatttgaaaccgggtctatttaactctccgagtaagtacttaagcactgcactgactgcttctctaagacctaattttcacagcagctgtgcacttttattcattttatggacgaagcaacagagggctgacattttgttgagggtcgccaagcagcaggatcaggtttgagacccagatctctagtctcaaactgtctcccaaggagtttacagaccaaattatcatcataataaagccccaggcttaaagagcattcctaagggcaacacgaaagttggattcttttgtcctctaataaacattaccactgtttaacagctgatattaaaaaaaaatcatgaattgcccaacctattcgaaacaatttagtaaatcatacgaaagagagtgtaaatccattattagtaaatagtttaaaaacacattttaggccaggcgcagtggctcacgcccataatcccagcattttgggaggccgaggcgggcagatcacctgaggtcaggggttggagaccagtctggccaacatggtgaaaccccatctctactaaaaatacaaaaattagccgggcatggtagcacatgcctgtaatcccagctactcaggaggctgaggcttgagaattgcttgaacccgggaggcagaggttgcactgacctgagatggcaccattgcactccaccctgggctgagactttgtctcaaaacacacacacacattttaaaatatgtttaaatgaaaaactgaggtctaggttgagggaaaaatacattattttaagaaaaagttttttagttgggggaagggctttacttgatttaaaagagagtacagaagatcagaaactcacattgcagtcccaaattggtaactttcttttttgttgattcattgaaggcatccctaaaagctcatttttatcaaattcaaaaataagaattgtagccaggtgtggctcacgtcaaaatcctacttcgggaggtggaggcaagagaatcacttgagcccaggagttcaagcccagactgggcaataagtgagaccctgtctctattaaaaacaaacaaacaaaaacaactaattgcatgctaatgccaccacttatccactcaagaaaaggcaactctacttgtaagctcgtaggctatgcataaagcaatcacaggttgttagtaaagagtacctaaaactaaggctagacagaaccattagccctccacagaggttgaatcttaaattttgtgaagataaaaattgcttcccattccaaatcaacatttattaaaaaaaaaaaaaactttaatgaaatgtagctgggtgtggtggctgacacctataatccagcactttgggagccaaggctggaggatcacttgagcctaggagttcaagaccagccttcaccatatggtgagactctgtctctatttaaaaaaaataaataaataatcctagcactttgggaggccgaggcaggtggacttgaggtcaggggttcgagaatagcctggccaacatggtgaaaccctgtctctactaaaaatacaaaaatcagctgggcatgggccaggcgtggtggctcacacctgtaatcccagcattttgggaggccgaggcagttggatcacgaggtcaggagatcaagaccattctggctaacacggtgaaaccctgtctctactaaaaatacaaaaaattagctgggcgtggtggcgggcgcttgtagtcccagctactcaggaggctgaggcaggagaatagcgtgaacccgggaagcggagcttgcagtgagctgagatcataccactgcactccagcctgggcaacagctccgtctcaaaaaaaaaaaaaattagctgggcatggtggtgggtgcctgtaatcccagctacttgggaggctgaggcaggagaaactcttgaacccaggaggcagaggttgcattgagtgaagattgcaccactgcactccagcctggacgacagagagagacttcatctcaaaaataatcataataaaagaaaaaaaattagtgaaatcagattttctatattatgccttacaaggtataaaaaaattaggagtctctaaaatataattttaaatacatattcatttattgtagatagcaaaaaaatttcagtttagctggagaacattactaatgttcactattagaaatattttttatgtattggggactaagcactgctacctactaaggatgtcattttgaagcaaatgaacagggttaccttcttcaaatttgctgttcagtggggaatgcgtctgaaactaggatgtatggtgatggctaagctgagacctaaaggtaaagtaaggagtcagaaacatgaggggcagaaaaggggtataaatttgctgaatcccacctatttcaggaaaactaacacagtgacatacagaagatacccatctaggtattcatatatgtttatgtatatagatatctttgggggggtgagtaccacagaggcacatagttctgaagcacgagctaccaaaagtttatgcttttaagtataaagcctgtagttgtctcctgctatcagtaatgggcaaagcagcagcacaaggaatattagagaacagtataaaatagtgtaaaattaaatttccagggaccacaattgccttttaaaatttggaaacataaaaataatcaatttcaactccacaatttaaaaataggaaaagagaggctgggcacggtgcctcacgcctgtaggccgtgagcactttaggaggccaaggcaggtggatcacttgtggttaggaattcgagatcagcctagccaacatggtaaaaccctgtctctactaaaaatacaaaagttaaggccgggtgcagtggctcacgcttgtaatcccagcattttgggaggctgaggcgggcagatcatgaggtcaggagttcgagaccagcctggccaacacagtgaaaccccgtctctactaaaaatacaaaaattagctgatcatgggggcaggcgcctgtaatccgaactactcgggaggctgaggcaggagaatcgcttgaacctgggaggcggaggttgcagtgagcggagatcgtgccactgcactccagcctgggcaacagagctagactccgtctcaaaaaaaaaaaaaaaattaacttggcgtggtggcacatgcctattatcccaggtactcaggaggctaagggaggagaatcacttgaacctgggaggcggaggttgcagtgagccgagattgtgccatggcactccagcctgggtgacagagtgagactctgtctcaaaaaagtaaaaaaataaaaataggaaaagacaatgactcaagatcatatagcaagctagtaacatttattgagtactttctatgtgtcaagacactgttcttttttttttttttttttttttgagatggagtttcgctcttgttgcccaggctggagtgcaatggcatgatctctgctcaccacaagctttgcctcccgggttcaagcaatcctcctgcctcatcctcccaagtagctgggattacaagcacccatcaccatgcccagctaatttttgtatttttagtagagacggcgtttctccatgttggtcaggctggtctcaaactcccgacctcaggtgatctgcctgccttggcctcccaaagtgctgggattacaggtgtaagccactgcgcccagcccagacactgttctaagagtgttacaggtgtagtctcatcaatgcccagagaaggtactgatgttatttccatttacagatgaaaaaaactgaggcagagcagttaattaacttaatgtcatttagagtgtaagttgcaaaaccaagattctaacacaggcactgtgcctccaaagccccatgccgttaataaccacaatatattaaacttctcttgaaacaaaatacaaaactcagtgcattttccactatgtcatttcatctcccttcctcaaacagtactttaaaagacaggatataaatagcataactcagcaataactatcaatattactgatgcataaccttttgacctagcagttctacttctagaaatgtatatggtacagatgtactcattcacattctaaatgtgtattcaaggatattctttagtgttgttaataatagcaaaggattggaaataagtatctatcaaaaggtatgtccagtggaatacagccataaaaaggaatgaggcactgatgcatgctacaacatgaatgaaccttgaaaacattatgctaagtaaaagaagccagacacaaaagcgatatattatagattctgttcatatggaaatgaaaaataggaaattccacagaaacagaaaaatgattagtggttaccaggggctagagagaagggggaatgaggactgactgctaatgagtacagggtttctttttggggtgatgaaaatattctggaattagtggtggtaattccacaactttgtggatatatttaaaatcattgaactatgtactgtatttatttatttatttatttatttatttgagatgagtctcactctgtcacccagactggaatgcagtggtgccatcttggctcactgcaacctctgcctcctgggttcaagtgattctcctgcctcagcttcacgagtagctgggattacaggcacctgccatcacacccagctaatttttgcatttttagtagagatgaggtttcgccatgttggccaggctagtcttgaactcctgacctcacgtgatccacccacctcggcctccccaagtgctgggattacatgcgtgaaccaccacatccggctgaactatatactttaaaaagatgaattttataatatgtgaattatatctcaaggtggtggggaggactaggcattccttgaggtcagagactccaagcagcagaaactctctcctgttgctgggtttgaacaaacaagctgccatgagttttatagctgccaacaacttgaaggaatttgggagcgaacccttttgtagttgagtctccaggtgagaatgcagcccagctgcatgattctagccttgtgagactctgagcacagaccccagctaagccatgcctggacttctgacctgcagaaactgtgagctaatacagtattgttctaagccaccaggtttgtgttagttgttatgcagtaatagaaaactaatacagaggtcacaatatgcctggcattttctttttctttctttctttttttttcttttttttttttttttttttgagaggggtcttgctctgtcacccaggctggagtgcaatgacacaatctcggctcactacaacctccacctcccaggttcaagcaattcttctgccttgggctcccgagtaggtgggattacaggcacacgccaccaggcccagctaatttttgtatttttagtagagacggggtttcaccatgatggccaggctggtcttgaactcctgacatcaggtgatctgcctgcctcggcctcccaaagtgctgggattacaggcgtgcaccactgcgcccagccatgcctggcattttctaagtgcttgcctggcattttctaagtgctgtgtgtgtgtgtgtgtgtgtgtgtgtgtgtgtgtgtgtgtgtttttgagacggaatctcgctctgtcgcccaggctggagtgcagcagcgcgatctcacctcactgcaacctcttgcctcccaggctcaagcgattctgctgcctgcctcaacctcccaagtagctgggactacaggcgcgatgccatcacacccggctatttttttgtgtttttagtagagatggggtttcaccatgttagccaggatggtctcgatctcctgacctcgtgatctgcctacctcggcctcccaaagtgctgggattacaggtgtgagtcaccgcgcccggccagtgctttgtatattttaactcatttgattttcacaacaacgctatgaggtaagtactcacattattcccatttttctaataaagaagctcattaggtgctaagtgtttaaaaaaaaaactggctgggtgcagtggctcacatctgtaatcccagcactttgggaggccaaaggcaggtggatcacaaggtcaggagttcaagaccagcctcgccaacatagtgaaaccccatctctactaaaaatacaaaaattagccaggcatggtggtgcacgcctgtaatcccagctactcgggaggctgaggcaggagaattgcttgaacccaggaggcagagatggcagtgagccaagatcacaccactacacgccagcctgggtgacagagaaagactccatctcaaaaaaaaaaaaaaacaaaaaaaaaaacgaaaaacaaaaaacaaggcgcagaacaggatgaatagagggttagtatttatatcaaaaaatgggaaatacagtgaaatatatacaaatatttacatctatttgcataaaactttactggaagtctacataagtagctagcaatattgattgcctatggaaagggaacaggggctagaagatagagatgggagagacttttccctctatgtcctttcatacttttcatgtaaaagacaggttaaaaaaaaatatatatatatatatattcttttttttttttttgagacagggtctccctctgtcatgtcatggctcacccagccttgacctcgtgggctccaatgatcctcctgccacagcctccgagtagctgggactacaggtgtgtaccaccatacctggctaattttcttattttttgtagatattggggtcttactgtgttgcccagactggtctcaaactcctaggctcaagcaatcctcctgcctcagcatcccaaagtgctaggattataggcataagccaccatgcttggccaaaagatgtgatttttgatgctcacatatatcttgagccttgtaggtcacacagctaggaggctttttgttttttaacattttcatttaaagacagtagtaaagataataaagtccagtcaacaaaaaagtaccactaacatctaattcatagaactttaaggatcttaattagtttgattcattttatggatgaagaaaatattacaaggttacaactccactgtccattcagatgcattaaaaaatgtgaaattgtcattccctccatatattgagcaacaataattctacttccaaggagtcatcctctttccccaaagggtttttctggttactcattgagcaaatatttcttaggtgtgtcctagtgagaggtgacagcgtgctagcagtcctcacagccctcactggctctgggcgcctcctctgcctgggctcccaatttggcggcacttgaggagtccttcagcccaccgctgcactgtgggagcccctttctgggctggccaaggccagagccagctccctcagcttgcagggaggtgtggagggagagccgcaagcgggaacccgggctgcccgcggcgcttgctggccagctggagttccgtgtgggcgcgggcttggcggccccacactcggagcagccggccggccctgccggccccgggcaatgaggggcttagcacccgggccagtggctgcggagggtgtagtgggtcccccagcagtgccagcccaccggcgatgcgctcgatttctcacccggccttagctgccttcccacggggcaggactcaggacctgcagcccgccatgcctgagcctcccaccccctccatgggctcctgtgctgacccgagcctccccgatgagcgccgccccctgctccacggcgcccagttccatcgaccacccaagggctgaggagtgcgggcgcaaggggcgggactggcaggcagctccacctgcagccccagtgcgggatccactgggtgaagccagctgggctcctgagtctggtggggacgtggagaacctttatgtctagctcagggattgtaaatacaccaatcggcactctgtatctagctcaaggtttgtaaacacaccaatcagcaccctgtgtctagctcagggtttgtgaatgcaccaatcgacactctgtatttagctactctggtggggccttggagaacctttgtgtccacactctgtatctagctaatctagtggggacgtggaggacctctgtgtctagctcagggattgtaaacgcaccagtcagcgccctgtcaaaacagaccacttggctctaccaatcagcaggatgtgggtggggccagataagagaataaaagcaggctgccctagccagcagtggcaacctactcgggtccccttccacactgtggaagctttgttctttcgctctgcaataaatcttgctactgctcactctttgggtccacactgcttttatgagctgtaacactcactgcgaaggtctgcagcttcactcctgagccagcgagaccatgaacccaccagaaggaaaaaactccgaacacagccgaacatcagaaggaacaaactccagacgtgccacctcaagagatgtaacactcaccgcaagggtccgcggcttcattcttgaagtcagtgagaccaagaacccaccaattccggacacactagggaagcctgaaaaagaccctcttaatttggcaagaaaccatgttgaagttgattcctggttaatgactggaagaaaaacttccatgcaatgaggagaagcaacaaaagggagaaattcaattgaaaaaaagaatatagttagcaatgaacaagaagcaagtgtcctctcaccaacacagctgactctggtaaccacaaacctcagctaaacccagaagtcaagagctgtcacttaagttttgtttcatttctgagtgaaacccttctaagactttattacatgcaatgccatggattaatgtcatagacataatgttaaatgaaagacgtactgtatgatcccatttacatgatgttcaaggacagacaaaaataatctatggtaataaaagaattgtggttcccttgtgggggtgaagatgtactgtatgatcccatttacatgacgttcaaggacagacaaaaataatctatggtagtaaaggaattgtggttccctttttggagtgggggtggtaggtaattgactcaaaggggacatgaaggaactttctggaatgatggaaatgctctgtatcttgatctgggtggtagttatacagacaggggcatacacatataagtattcattgaactgtatgcatagagttgcattttattctgtgatgttattcttcaattaaataaacaaaaacaaaacttttctatggattctcattattccagggacaaagataagaattcttcatgtgggcaatggacccttactgattctgacctttgcctgcctttccatcttgcacttcacttccctaagctcctccttggttcttcctatgtctggcacacttgccaaactccctggccatgcaatcaacctcagcacatgatatgtttcctgtgtgggatgttattcttccccgtgccaccctcttctccagttccagtaagctactgcacttcctttggctgaagcttcacttccctgtgtgaacttctttcataatcggccccccattctaggtcgagttccccattggatgctcttacagaattttgctccttttactcagaccatttacctcccaatttcctcaatttgtaattactccctcatttgtgggactatttaattaaatctgtctctctcactacagtctgtgccataccatggactgagggtcaatgtctgggttctgcttaccatggtatccccagggctcaccacagtgcctggaacacagtaagtgtttactaaatatgtttttgggccgggcgcagtggctcacgcctgtaatcccagcactttgggaggccaaggcaggtggatcacgaggtcagaagatcaagaccctcctggctaacagggtgaaaccccatctctactaaaaatacaaaaaaaaaaaaaaaaacttagccaggcgtggtggcgggcacctgtagtcccagatacttgggaggctgaagcaggagaatggcgtgaacctaggaggtggagcttgcagtgagctgaggtcacgccactgcactccagcctgggcgacagagctagacttaaataaataaataaatatgtttttgactcctgaggataaagtgactatctgatattctctggcagaaaaattgttgatgtctcacattacgtgatttggatttatccccattaaatgtttggtatatcttgctttaagcaaactgaatccattatatggaaatctgtatttattcaaaatataaattagagtgcatgtactcaaatgcctgttacgagatttatacaagttccaggtgttttttactgcatttgaaaaatagatgagcttcatttgccaaattcaagcctagttgaaatcaatagggtttaagaattggaagtgatggttttcttctatcagctgactggccagtatagacgcagttatagagtcatttacaccactgccattatcatctgaacaaagatctaaatttatactaacttcacgttgtggttggtggagctctgtaagtaagaaggaggctggtgccaacaatccaagttacacaaagagaaaaaaaatgctcaagaggaagtggtacactacaaaagtgcaaacgtaggtggaatgtgtgaaaaaaaaaattttcaaattaaaagtgtcttcgattttatgtttttatgataaaagaggccaaaagaaagttgtctggaacttcctattttcaagataacccatctcagcactcaatttggaagacagtgaataagttggaggaaaagaagtaacaatacagagagaacatgtgaataacaccttgcaatttaccaaatgcttcacttattctctcaacctgctaccaggccctaagatgggcttctgaggttacagctgtaaacaagcagatccatcctgaccctgtttgttttctgatgcttctatacccattgcctcatttaatcttcccagcattgtcagagaaacattgttacatttgtcagatgaggaaatggtaacttaactgccttgctcaaggaaacatcaccagtaagtgagggaacaggactcagatttgcctcctaaatctaattgcaaacccttgcaactaccccagttctacttgcttataggcctctgggatggctactttgttaatcaagactctcaatggaaatcaagaaaaattacaaagttacccactgggcattttaatcattcctctatgtatcatttctctcccttgttttgtcctttcatttttctgagtgaacaggaatattcccaccaactcccttaaaaacacaagtttcttcactaatttctcgtagctcctacagatttatatatgatttctgggcagacagaagtaatcaaagtcatccaatttctttggctgaccaataactaaattgagagctgcttcccttttaagtcacatgattcaggttattgttttattatttggtgcttcatagtaccagaaaggtattcagacttaattttggacattttctccccagtccataaaagcctggtaataaaaagatatttgacatgaccttttgctatatggttggtgctacaaaatgctgattttaagagaaattagcaaaagtacatcaacatatgaagagatgaacaagatatcttacatttatacaatggaatattatttgtccataaaaaggagtgaagaactgatacatcctgcaacatggatgaacctggaaaatactgtgctaagaaaaagaagccagtcacaaaatgctgcatatggtatgattctgtttataggaaatgtccagaacagggaaatcaatacagacagaaattagatcagtggtttcctagggctaggttaatgagggaatttggggatgatagctaaagggtacaggttctttttaaggtgatgaaaatgtagttgcataattctgtgattatcttaaagacgattgaattgtatgctttaagtcagtgaattgtatggtgcatgaattatatcaatgaaacttttttttttcatgtctgacgggtaatgtgctgaaatttatgaactaccaaaggatctaaaaccggttttttattattttttatttttatttatttatttaatttttttgagacggagtcttgctctgtagcccaggctggcatgatcacagctcactgcaaacttgaactcctagcctcaagtgatcctcccacctcggccacccaaagtgctggaattacttacaggcgtgaacccccacacccagccttaaactgttttttaaaaaaggaggttgatatagtgttccactaatagcttgggggaaattctttctcaggtatataatacaggaagttatttgacaggcaactatgcttaaatttatgttaattgtgtagaaagaactgagtaaatcatttcctgttttctctccacctgcccccaccaaaaaaagaaaagaaaaaattctaaatttgaccaatacaataatagcaagataacgcaaagattacaatgggatatggcctgggtcaattaaagcaccagcaattggcattggaccctccaccttatgcatgtctatatccagccatgatgtgaatatgtgagtagcaaaagtgctagctgtgtcttttcctgatttttttttttttttttttttttttgagatggagtttcactcttgttgcccaggctggagtgcaatggcgccatctcagctcactgcaacctccacttcccaggttcaagtgattctcctgcctcagcccccagagtagctaggattacaggcatgcgctaccacgcctggctaattttgtatttttagtagagacagggtttctccatgttggtcaggctggtctcgaactcccaacctcaggtgatccacccgcctcggcctcccaaagtgctgggattccaggcgtgagttaccgtgcctggctcttttcctggtttttatattttaatgattcgtattagagttaattcacattaaccctcttcaaaaagaacattaaacctaaagcccagtgacttaacaacattaaatattccagattcttttccccaaaaagttccatttcaactcttggaaacaaaaagttagataatggtttggctttaaatgcctcatttcaaatgtccttccccataatactcccaagtgaaaaaaatattttttcccaattattttttcatttaatgtaaaacattccagttaaaagagattctcaaaaatagagctttacaaaaaatacgagttcaagtttcagtaccctacccttcccccacccccggcccagtggctctgaaaagataggcaattaataataagttttttcctaagaaatctttggggaaccagccaagtttaaatagggtaattggtaggtctatggttgcaatttacataaattatagaaacataacaccagacatttatctaattgaagaaaatgtggtgttcagttacttatctagaggaattctacttgcagtttgtgccatttggtgattagtccattctcttgagaatctgagttgctctagagacagaatatatgataataatggtccaaaaaatcagttttgcttacttagcaacaacaaaaaatatatattaaaaataaaatactattcatatacatttccttgataaaaatagtattgaaatagtataaatccataattcctttagaagatgcttatccacattcctgttagagatgtggagtagttaacactcaccagatgatgctctccttccttccttccttccttcctttctttctctttcttttttttttttttttttgagatggagttttactcttgtcgcccaggctggagtgcaatggcatgatctcggctcactgcaacctctgcctcttgggttcaagtgattctcctgcctcagcctcccgagtctgggactacaggtgtgcgccaccacaccctgctgatttttgtagttttagtagagacggggtttcactatgttggccaggctggtctcgaactcctgacatcaggtgatccacctgcctcagcctcccaaagtgctgggattacaggtgtgagccaccgcacccgccaatgctctcctttctttcagtgctaaagaactcttcactctcttaatcaatctgttattacaagtcctatggccctttgttgaatttctgtttactagaaatataataagcaacgtaagatatttaattttgtcaaagtcgttccaaatctcttatactaaataagtataaagatactatatatgtatatatatatgtgtatatatgtgtgtgtgtgtatgtgtgtgtgtgtgtgtgtgtgtgtgtgtgtgtatatatatatatatatatatttttttttttttttttttccacccaggctggagtgcagtggtgagatcacagctcactgcagccttgacatctctggctcaggtgatcctcccacctcagcctcccaagtagctgggaccacaggcatgcaccaccacccgggctaatttgtattttttgtagagatgggattgtgcaatattgcccaggttggtctggaactcctgggttcaagtgatctgcctaccttggcctcccaaagtgctgggattccaggtgtgagccaccatgcccagcctgataataagcaaaattccacttccctagtgctacagactaaatttttatgtcccacccaaattcatatgttgaaactcttaggatttcaccatccttgataattgtcagataaagaagtaggacctttgggaggtaactaggtcatgagggtggagccctcatgcatgggattagcgtctttataaaacagacttcagagagcccctttacccctttagccatgtgaggacgcagtggaaagatggctgtccacgaatgagggagtggttcctcaccagacactggatctgccagtgccttgatgtcaaacttcccaccctctagaactgtgagaaataagtgtttgttgtttataagccaccagcaatatggtactctgttacagcagcccaaactgactaagacatctatttcttacctgaaggagtttgaagtggggtcaaatgcaagttttacattcttttaaatgtaaaagcctgggcgcagaggctcatgcctgtaatcccagcattttgggaggctgaggcaggcggccatcacgaggtcaggagttcgagaccagcctgaccaacatggtgaaatccctgtctctactaaaaatacaaaaattagccggaagtggtggtgtgtgcctgtaatcccagctacctaggaggctgaggcagaagaattggttgaacctgggaggcggaggttgcagtgaaccgagatcacgccactgcactccagcctgggcaacagagtgagactccgtctcaattaaaaaaaaaaaaaagacaaaatagcatacaattctgtctcaaagcctcaagtacctttaactacagtctgtctacaataacctaagacattcaaaagacaggagaatgctcataccctcatgctgggacactgataatctggagcttactacattgacatcactggcacccacttactaaacacatgcaattacttagcaattagttcttgaacaatttgtgtttgctaagaactatatctgacccagggaataaaacataagacacagttcctgcttgtaaatacactagcaaaagagaagaagactatcttgtagagactagctgagtcagtgaatgtcagagatgaagaggaagggcaatggcatgagtggaattccaggtagagaaacggtgagagaaaaaaagaacaaagataccaatgtgagaaacaaaaaggtttctgcagcagggaagcacagttggctgttgtggtatacaggatgaggcggcaagtggagaggcgggctggtctgaaggctctagctgaatcacagaacatatgccacattaagggatttggatttaatcctgatgcaaaatataagaagttaaggattttaggtagaagctgacccaatcagtcgtgcattttagacagatcattctgggtttctttgttgtttttaacttttcatttctttctctctttccttttttctttctcttcctgtcctttctttctccttccttccttctccttccttccttcattccttctccttccttccttccttccttctttcttcctttctttcttagggtctcactcggtcacccaggctggagtgcagtggcacaatcacagatcactgcagccgaaacttccagggcccaagctatcctcctacctcagctccccgagtagctgggaccacaggtgtgtgccaccacacccagctaattttcttattttttgcagagacgggagtctacctgtgttatcaggctggtttcgaacccctgggctcaagcagtcctcccaccttggcaacccaaagtgcttgattacaggtgtgagcattctggttctcgttatagaaggtggattttaggtggattggagtcaacaaaactacttaggacattgttgcaaaaatctaggtaaggatggcttagaacttctccatccttggtcattgtcagcctagatacaaactgaggttgcactacagtgtgagagaatttcaaagaagcaggaaagaagtagagatgggttttactaaagtactagtaatcacagttactaaaggatgctgttgtttttcccccactccccaccacattctttttttaacatgtcagtaatttataactttctgaaaggaccaaataataaaccataaaatgatgatgccaggtgttttgttacgtgtttttgttgttgttgttgttgttgttttgagatggagtctcactctgttgccaggctgaagtgcagtggctcgatcttggctcactgaacctccgcttgccaggttcaagcgattctcctgcctcaacctcccaagtagctgggattacaggcacgcgccaccatgcccagctaatttttttgtatttttagtagagatggggtttcaccatgttgaccagaatggcctcaatctcctgacctcgtgatccgcccgccttggcctcccaagtgctgggattacaggcatgagccaccatgccaaggtgttttaattgtttttggtgttttgttttgttttgttgttttgttttgtttttgagactctgtctctcaggctggagtgtagtggcaagatctaggctcactgaaacctctggcccctgggcttaagcaaccctcccacctcagcctcccaggtagctggaactatgcaggtgagtaccactgcacccagctaatttttgtattttctgtagagatggggtttcactctgtggcccaggctgatcttgaactcctgagctcaagcaattcacccagcttggcctcccaaagtgctagaattacaggtgttttaaaataagccaaataaaggatataaacacttccaattcataattcagatgtagaggaccttacaatagttaacaattttcaagctaaaaatcacatcatctataaaacattataagtgttttccttattgaaatggtttagcggaaggccgtagggcttgaaatggagtgacggaacacaaacatgtaagaacagataagaagagtggatggttagtttaggaaggttttccctttccattccaagactagattctggcaatatctggtatgtcaaactaagatatgtaacatttaaatacacaatattatttttattgtgaaaatagtttaaatatgtttagaatataaaatttgggctgggcatggtggctcacacctgtaatcccaggacttgggaggctgaggcgggcggatcacctgaggtcaggagttcaagaccagcctggccaacatggtgaaaccttgtctccactgaaaatacaaaaatatagccaggcatcatgtgcgtgcctgtaatcccttgaacccgggaggcggaggttgtagtgagctgagatcttgccactgcactccacactgggcaacaaagtgatattccatctcaaaaaaaaaaaaattgtgccagacgcttgcagaacgcctgagacacctccatgaaattctaacaatgcatactaaatgctttataatccttctgttgaaaaccagacattcaagagcatacagcttaattccagcagagggcagcaaaacttcactaagcagttttcaaaaccctagcagcttttctgtattacctaataatatttttaaaatattcccccagaagagttctgtagttccacaactacaatctcatagtatttgtggaattacagtattaccatacttatatttaggcaggacagaattcttcccagagttcaaagactgcggaaggctcttagatggataggacctggggcaatgccaagagggaataaagacgagccacaatgtcttactggggtcatctgcctggtggttttccaactcttttacaaagagtcatgatttaaggtacaatgggattcttttaaaaaatatgttgtcactgcaggtatggtggcccatgcctgtagtcccaggcactggggaggctgaggtgggaggatcacctaagcccaggagttaagagtcctgcctgggcaacatagtgaggctgcatctataaaagcacgcatatatatgtatatgtgtgtgtgtgtgtgtgtgtgcatatatatgcacacacacacacaaaatatatatacacacacacatactcacatattttatagttgtttatataagcatgtgtatatatatttataataacagttacaacatatatatgttgtaactatgggtctgagttttctcatctgtaaaactgagataataattgcaccagcagggcgcagaggctcacacctgtaatcctggcactttgggaggctgaggtgggtggatcacgaggtcaggagttcgagaccagcctggccaatatggtgaacccccatctctactaaaaaataaaaaaaattagctgggcggggtggcaggcacctgtagtcccagctactcgggaggctgaggcaggagaattgctggaaccagtgaggtggaggttgcagtgagcagagatcgccgcactgtactccagcctgggcaacagagcaagactccatgttgagaaaaaaaatggcacctaggccagccacctgcagtggctcacacctgcaatcttggcgctttgggaggccaaagggggagaatcctttgaggtcaggagttgaagaccaacctgggcaacaaagcaagaccccacctctacaaaaaaattaaaaactagctgggcatggaggtgcatgcctgtagttctagctactcgggaggctgaggcaggaggattgcttgagcccaggagttcaaggctagagtgagctatgatcacgtcactgtaccacacactgtataatagggcaagacagtgtctcaaaacaaaataataatgattgcacctacatcttaagaggttgttgcacagattaagcgtaatgtaaaatgactggaacactgttaggtgtggtttttgttgttgttgttgttgttttgtttttttgtttttgtttttttttgagatggagtctcgctctgtcgcctaggctggagtgcagtggtgtgatctcggctcactgcaagctccgccttctcggttcatgccattctcctgcctcagcctcccgagtagctgggactacaggcacccgccaccacacctggctaattttttgtatttttagtagagatggggtttcatcgtgttagccaggatgttctcgatctcctgacctcgtgatccgcccacctcggcctcccaaagtgctgggattacagctgtgagccaccgcgcccagtcactgttagctgttttttaaaaaaattgtaaaatacatataacagaaaatttaccatctcaaccttttttttttttttttttttttttttttcagatggagtctcactctgtcgcccaggctcctaggctggagtgcagtggtgcagtctaggctcactgcaacctctgcctcccgggttcaagtgattctctggctggctaatttttgtattttttacagaggcatgttcaccatgttggccaggctggtctcaaactcctgagctcaggtgatatgtccaccttggcctcccaaagtgctggaattacaggcgtgaggcactgcacctggcctcaaccattttaagtgtacagtctacataagcagaatatatatgggagaaaaaagcatacagtccaatagtgttaagcatattcacactgttgtacaaataatctcctatccccttttcatattgcaaaactgaaactctataccaattaaagaacagctcgccatttccctctccccgcagtacttgctaaccatcactctacttcctgtctttataaatttgactactctaagtacctcatagaaatggaatcatatagtatttgtctttttgtgattggcttgtttcacttagcataacatcctcaaggttcatctatgttttatcatatgtcaggatttctttttaaggccgaataatattccattgtatgtacacagagctgttacattttaaaacagaaatttaaaaaatgactttgagactcctgcttccaattatactgatccccccataaacaactagaaaactggccaaaatactctaaacaactatattcagaaatcagacaataggcagtgtggattgtaatccctaaaagaaaggaaacaaaaaggtaaaccctaaaaccacaccggaattttgtctgaaggcaatttccaggttgtggatgcggggaggggaatgcaagtgaagctgagcaatctctccgagatttggggagcagaaggtaactgaaagttgccaggcaaaattctagagaattggaagctttgtagaaaaagagtttcagaagaccgcataggaagtccccttgactatgcatgtgtggagtaaaaccttcatgaggctgagaaaataaagacttggaattgtaaactgaattacactcagtgttcaaactgagtggggagaagtgagaacttcaattagccaaggtcctgaataaccaatggaaagtcttcaataattaactgagccatgtgacaaatattcagggggatcatgcttagacggaataatcctggagtaaaggctaatctatatctgccatagcaaaaattaaaataggccttaaaagtatcaaactgggctgggtgtggtggctcacgcctgtaatcccagcactttgggaggccgaggcaggcggattacctgaggttaggagttcaagaccagcctgaccaacatggtgaaaccctgtctctactaaaaatacaaaaattagctgggtgtagtggcacatgccagtaatcccagttattcgggaggctgaggcaggagaattgcttgagcccgggagacagaagttgcagtgagccaagatcgtgccactgcactccagcctggctgacagagtgagactctgcctcaaaaaaaaaaaaaaaaaaaaaagaaggtatcaaaataatctataattagcttacctgcctgccataacaaagcctgatcttctcttcctctcttctcttctcttcctttgtttccagctatgattgcaccactggagtatggtggtgcaatcatggcccactgcagcctcgacctcctgtgctcaagtgatcctcctggcctcccaaagtgctgggattataggcataaaccaccacggctggactaatattcttcttcttttttat

SEQ ID NO: 1242 - DNA, 2704 bp, Homo sapiens
taatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtat

SEQ ID NO: 1243 - DNA, 103525 bp, Homo sapiens
ggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgacgagaagacaactaaaacatccacactaaattattagtgttttgacattacctaaaccctaattatgtaatcagatgaattatttaaattatgtagtaaaattactatttaatattattaaatattgagttgatactacttatttagttaaagtatttatattattattgaattaattaaattggttccaaaatgtctttgacacatatataaaacatacgtgtaacacagaaaatggctttttaatcagatatcaataatttatagggactaccaatatgaaatataagctgattgagctggctttatttgtgttaattacatatgacacggtctattttctaatacttgtgacccattatttgtacaaatccagggaatatacaagactttcaaagatatatatcaaagcacatgatctcaaatactatattttctaattagacaaaataatttcacttggtagacaagatcctattagtatatttcatatcacattgctgttattaatctattttgtatttaaaattctgaaaatcattacacttagactgattcatttacctagagagtccattcaaaaaaattcatgaaaacaaacaataagcacttcaacaaatatgcaatgactcttctgtgaatcccaaaatattatgaataacttttgtcattgtaatttcttgtacctcagaactgtattttccctttacttcttttttaccatccctcaaaatattttctatagtcaccaaattttagaagacaatagcagtaaaaggaaaataaaagccttttgaaatgcatgcttaagtaggacatttcccaaatcacctttttaaagacaattcactatgaaacccttaaggtctataaagcccatgtgattttattcgctaggcagatctaagagttgagagacagttgacactttttaaatatgcgttttattaaattacttgtgaccacaagcattaaaccaaatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataataataatacatgtaccccctgaatctaagagtttgttacatggctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggcctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatctcttactgaagctcatgaaaaagaagcagcgtggctttgtataaagttaatccacctctacagaaaggaaaaataaattctgcccctacaaaaagttctttggaacacttaatccttagattgatacaaattatttagttttgaaggaataagaactatattaacccaatttcacatattctaagctcctaattgatgaccctaaatatttttgaatcaatcaagctaatatgactaactaaaataaatatcattttcttcctcagtcatagattgaagtctgagttagatgagaacatgaaaggagctgtggtgtcagaactgcaattatattcgcagggtcattcagactttacaagagcttacagccattgataactttaaaaagtgtttctactttgaagaaatgcggtgagaaatggagtcaatatttttagaacttaacattgagttttgttttccattttaattgttactcttttgcttgatttccaaacattattatgttgcaagaacagtataaaaatccatgccataaattccattaaagtctaacatgagtcacaaaaatgtatcaaaactcattatgagtgaatgacattaccttgattatctatgattgtaaaacttgaattgttagtgtcttctacagatagattaaagtaaaaatggtgctcttctatggattcatctctatccactgcactgatagtctgaattacctaaaaaaaaagggggatagatttttgttgttgtttggattcaggaagaagatcactgctgctattattattagcttttattcacattgctttattacaatcaatagggacattgcagaaaataactgtcaaatcagtggagaatattaaaatgttttttctcaggttaaaaatatgttcacttccttttttcaaagagtgttgtaatattacataataaacaaactcttgttgatggatcaggtggattccaaaagctgtttgttgaaagtctccaaagcattgcttttgtattactcacatcctccctgcctacatttcactctttcttccttcttaactttttctttatctgaatgtcagacattatgatttgctaaagttgtctatttcctgtttttactgagagcaaaactgtggtagagttactggcttactaaactatttgctgaagtaatgagatttgcaattgattgaggaaataatgcatttaaaatgtaggggcaatgtacatgatttcctttgacccataatgattataggaaagtgttttacatcaaataagttcatctctatatctcagatcataaaacaatgaagtactgcagacatgaacaaatccattttcaattaattttcttctttcaagacatgaatctgtcagtcaagtagttcattattgtcgaaaaagatatgctgtcaagatcacatagtgagattgtgattaattgtggaaattaaagtaaattgattatagaagttattgtttcgaattttctacaattaaagtgcctttaacaatatgtcaaacaaaaatagcctcagatgcaagatgacaagcccagatttatattatacttcaaaaaaatagatacatcttcacaggcataaagaacattaggaaaccaatacgatctgtatattacttctccacattgatttatttttaactcattacacattactaataaataatattcatttagtgttaattaagtaatttaacaaaacacattttattcaatccatgcttataattatacatgtggatattgatttatgttaaggtaaagccttcattttagaatattacaggattttgtataggctgggtagagggcaggggcttggaaacccaatattctgaatcctggctttgccatttagaagtttttaaccttgaaaaataaaaatactaatacttaaccttcagggttcattttcaggattataggtcttggcttgtcagagggtttgtcacacgacaaactattatgtgttcctatgtctattatgtgttcctcatgaaaatattctcttgttgagtttttgcatatcatggtgtcctgaatattgttagtcataggcatatggatatctttatatgcacatttgctgaaataagattgataacaaagtatagaattcatgtttatcttgctggcatatgtggctacagtgttcagataaggaatattttattttactacctgatgttctgtattaaacatgagcatctgagtaaatgttgcaaatgtctccctttgggaatgaagacttaagaagactggagatatgctgtatgtatgtcaaaagatttttaataaatcaaaataccttatgcatatgtacaggaaactgaatgagcaagatttcaacagtctgcctccttttaaatgatcatgtctccacttatatttgctttgtaagttgggcttccaataagatatgttttactggctttcataattactttataaaaataggaagacacagacataaaatgagtcatatatcaagtattatgaattttattgaagttaccttgaacaggtacacttaaacacataccactaataaagggaccacattaatatgctaataagttttgatggaggatatttatttttcctttaaatataccaatggaaaggttttcattttcattttaaaataaaattataagaaaaacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacgtagaatgttggccaatttatttctgatgcagtacattcaatcatctatatacagtgcattgaaagctacaatggaaatacattgtgtaagccccaagaattgaaaagtaactacaatttaataagaacttacctatgggccaggatctgttctatacattatcttagataatcttcacaatggtctctggaataaatcctattattgttcccatgttataaatgtttatattaagcttcatataagctaagtgtcttaggtaagtaaattggctgggccagaattagaatgtaagctgatgtcataggcaatgtgaaatatgagtagtaagtgtagccctctaggacatattgttcatatcctagacttgttcttgtcctaccagatttacatacaaaatgataccgtaaaagacatgaaattccaaaagcaagtaaaaatatgtctcataaaagttagtgacagagaaataagtaatataattttgtagaataaggaccaaaaataatggttaaaaatagaagaaaataatgtgttttgatatgggagaaagggaagattttctagggtaagagtacagccaatgagctaatactcaaataaaaatatgaattgaggaaaaaagtgtgatcccaagcaaagaatatcaagaaaattaatgaaggcaaagatatcatacattaggtataaatgtatgaaattaatattttgtagattaaagatgacctactaatggaagtttcataagttccaatttagttattttatgaaactataatcactatttgactttaaagataatcaggagaataaagataatcatttgcctgctattaatcattatgcactatgtctttttttaagaaaaagtcacacatgggccagtttactaagatatcattccagattaattatcctgagccaaaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaagatacaaatactgagtattaatttatataactcatcaattccttgaagtgcacttaataaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaaattacacctgttttgacaaaataaatctataaaactcaaaaaaggtgttgaacatctgttcaaacaggcagagtacaaaataatacactaatagaagtagaaccaacaagaaagtctaggttgtagtatgcttgttgtctttctttgtttagcaaaatattagaagaaaaatgttcaaaaggtcattatagcataatattttagacctggatagaactgaggatactctaagttttctaaaaggatttttcacaaagtttcattatatttatttaaatgtcatagatattataattgtttttgccattaacttgtagaaattgatattcagttgaaaaatacacattcctagatttttatctcaatacgtattttctaattttccttttaaagttaatattccaaatatacttttaaaattcacataaaatcagcatgtatatggaaaaatattaaactataaaatatctcattagtatcttaaatgtatccatttaaaatgtatttcattagtacttacagcactccaagcaatcctatgccctggtggtacaatcatggataaagttagtctctgtcaccactgttcacattctagtggtgaagaagatcaagcagaattgcaaacttaaaaagtattgaggaagtacagaatacccaaattacattttaaaagttataaacacctaaagtacttaatacttaaatattggggggtcagagaaccttgtatctgtgctgaaattagaagatcatacagcagaagtgagcaggggatacatcgtggacatattaaagagttttgactttatactgagggacactcccaggctctaagttgggaatgacatgatcattacttttatttgggatcacatggttccaggcaaaggactgcattttagaatgctccttctgaggacatccttagtgtaagtctggaaatagagaatctagtccgcaagctattgtcatgatcctattgaacaactgcttggtaatcaaaatcactttatgtgatatacaaaaaaacccactaacaatcacaattatggaatgtgttattttaaatgagaaacaatacagaaattactgagcagtgttcataaattgagaatggtacagtatgcttcaaatagagatataattcctgagtcccaaaatttgcctaagggtatgctgagctccagaagatgtcaccaaagtaatgttttttcaccattttcaagagggctatatattctcctcgctactctccatccagtaaaatctgattctcctgaaactgcatgactgcagtcttacctaataaatataattgatttataaaactgatacattgctgcatatgtgctgtgagattggatgaaggaaagtttgattttacaggaacatccctctgcagacctgcttaggtcaggttcactctagaagagaagataggtcccttaggttaggttcactctagaagagaatataggttcctattagggtagaaagaatgatgatagagagaaattgatacattaaagacatatgtaggagatgggatcaacagaaccaaattattgattggatatggagaataaagactagaattaattaaaaatgatgtccatatgtctttttttcttgcaaaacttgatatcataataattttcctagggatactgaagaaagggaaggcttaggagcaaatttggtgtaaccatgggacatctgagttgttttctcaggttagtcagacacatagcttaaaacagaaaaatcaggcagagatacagttatttggatatgaactgtagtcgagaggaagaagtggataaaagaagaaataatgagttcaggaaacttttggacacaaaagtgaaaggaagagaatcatagatcacaaaatgcaaccactgaaatttaggaaaaagaaaatttttacatggagacaaggtaaatgtctttagacaaaatattggtatgagtgaatctgaaaattatcgatattatactttacctccaaaaaaaaagacatttaatatcagtcaaaataatggcactcagtgatttgaaaaatgataactatttgcaccacatggcaaaggcaaattaccctgatgtcagctcatttattatattaatatttgcaaattgctgaaaattctctcctactcttccccaccctggccacttacacattaagaacaaaaccaaaaattttgtttacccacataggtatttgagtaaatgtttggattcctccagagtagagtgtgactactctggcatttttattttctatgatcaatttattatccatccaaagtagatagatataagacatccttttacctgccattttctctggctgtttgagcatgtgggaaatgagaaaagaatcatcttcataaattaaaaatatgtataaaatatttaatattctgttaatgattttaattaaaagtatgtgaagatgatattttggatatattatatcaaataaacattactaaaattaacattatctgggtgttttttatatttttaaacgtggctacaggaaaatttacaattctatcatttatttggaagcactgcattacatactcatattttcaaataatttttctttttttcagtgactttattttatatgtactttatatattgtatgaaatttggctttagaactccaacaaataatagtgtaagagaaggcattgttttcttattactgttttaaattatattaccctatcagtttcaatattacataaagttttgattatcgattgaggactataatattttatcattattatacgtattatgtgtgccttttgaagtcttatatttattacctaggatttaggtttattattcttattcattacttatttatttatttatttttgagatggagtttcactcttgtcactcaggcttgagtgcaacggtgcgatctcggctcactacaacctcttcctcccaggttcaagcgattctcctgcctcagcctcctgagtagctgggattacaggtgcccaccaccgtgcccagctaatttttgtagtttcagtagagatggtgtttcaccatgttggccaggctggtctcgaacttctgacctcaggtgatcctctcgcctaggcctcccaaagtgctgggattacacacgtgagccactgtgtcccacctaggtttacttttatctgagggtttcttagcatcaaatgaaaagttcgtgtatataatttttatgtgtattatttagttcctttgacttgatatgtaaaatatttacagatttcaaagtattgtatattgttaactttttattatttttaggaaagtttaaataacatgaaaattaactgtaactttgaaactcaacgatacaaatctcttgaccgaaaatattccttagaaacttctctgtgacatagtctcagtattattaagcataattgttttaatcctcttttctatttttcttacattatttcattttatttcattccagtctaatgactttttttaaaaacctgcattttgaaatgattatagattcacaagaaaatgtaaaccctgtgcatgcagtctctcagacacttcattcagctaaaccaatggttacatcttatgtacctgtagtacattattaatatcacacacgtatgatgacaaaacaaaaaaatcaacctctataacacatttatagtggagttcttaacttttgttttttactttgttaattcgactcccctaaacatctgatgaacgacattattaacctgctccactctcatctccaacagacattgacaatgttgtttgtgtgcaatgtcaagtgtacatagacaccgtgtagctaattcaaatctctttagaagacaatgaactccatgttaagaacttataatgtatgacatgacccttaattgtcactgttaatattaacaaaactacttttaccacagtcctcttttaccttctttcttatttgttttttatctttacaaaatccttagaagatagagattgtagaggagaagctgtattattatttttgaaatgaggagattagtattcagcatggttaggatattatcatctaattggggtagtgtggatgagtgatagagatcttcagctattgcactgtgtaatctttttgttattgtagcttgttgtttttgatgtttcattctcacataaggggaaacatatttgaattacatctcatggtttcctatacatgtgatttttagacaataatcaagaataccaatcagaaattccaggaacttaacactagaaaacaaatgtttattgcaatcctctctaaagaaccactttgcctttcaaaaacatgggacaaaacaaaacctaacaaagaaacaaaaaacaaaagacatttaaataatacataaaaagaacaacacttattttgctatcctgctcatttttctcaaagggtaaaagaggcaaatccatcaaattcaaaaagatgcactcagctatcattggaaagctgtgtgctatgtattgcttaagagtaaatgagggccaggtgtgatggctcacacctgtaatcccagcactttgggaggccgaggcaggcggatcacgaggtcaggagatggagaccatcctggctaacatggtgaaaccccatctctgctaaaactataaaaaattagccgggtgtggtggcatgcacctgtagtcccagctactcgggaggctgaggcaggagaatcgcttgaactcgggaggcagaggttgcagtgagccgagattgcactactgcactccagcctgggtgacacagccagactctgtctcaaacaaaaaacaaacaaacaaacaaaaaagtgagaaacgtgatagacagttccaatcgaaagagaaatagagcagcctcagttattaaacgcctatcttttttaaactctggccatcctggggccaagaatgataactagctggaagaaaatagctgtttttttttttttttttcagttttctgatgctgtagcacatctaagcaatctctaaaatatacaaataaatccatcatgaaaaagttaccaattatttttggagataaggaatttttttcaaaagagtaaagaaaatattgtataattttttctttttttgagttaatttgagttattgtataactgaaaagaacaaagaaaatattgtaaagcataattttaagatctgtatatcttcactgaaacacatttggagaattttatattgttttaaaattttatattttacccattctacctattaatagatttgcattataaaaaaagtgaaccagcaaatttcatggacaaccttataatcacatcacaaactttaaaaaacaagttttacaattcaaagaattttcctttaattatttttcaatacaagtcttcaagtctgatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcagtttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaagtcacccacggtatttacattaagtcatttactacatcaacacgaggtactaacttttataaagaacatttcttatcaaccagcaaatattcttgcatattgaggacagaatgacttcttcaggattttgcaaataattatcttctcacttatctctggcctttatttatttatttatttattttgtttgtttgtttgtttgtttatttgtttttgagacatgtcctcactctgtccaggctagactgcaatgatgcaatcatagatcattgcagctttgaactcctgggctcaagtaatcctccctcctcagcatccttggtagctggttctacaggcattaatcaccatgcccagctaattaaaaaaaaaaaatgtagagacggaatttcacagtgtgaaagtccagtccagaaaggctggtcttgaactcctggacttgagtgctgctcttacttcggcctcccaaagtgctgggataacaggtgtcagccatcaccccctgcctgcctttatttttaattaaaatgtattagtctgccaaaaagttacagggtttatgtagttacttgttctgttgttgttgttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatttttagtagagactggggttcaccgtgttagccagaatggtctcaatctcctgacctcctgatccgcccgcctcagcctcccaaagtgctgggtttacaggtgtgagccacccagcccggcgtagttttgttttgagacagagtttcactcttgttacccaggctggagtgcaatggcgtgatgttggctcactgcaacctccacctcccaagttcaagtgattctcctgcctcagcctcccaagctgctgggtttacaagcattcgcccattcgccactacgcccggctaatttcgtatttttagtagagacgggggtgcgccatgttggccaggctggtttcgaacccctgacctcaggtgatccacctgccttggcctcccaaagtgttgggataacaggtgtgagccactgtgcctggccagttatttgtaatagaaacgattattaatgttttacacagctttcaaacattttttatacaatttgactttttatcctttttcttttaaatataatatgttttattatatatattttttcttctttttggtatagttactttttaatatgtttcatattaattcgaacacatttaagcttaaagagttctgtgctattcctaggatttatgtatttattagacatttaaaatattttggccttaaaaaaattatttaacaactttctatagggatatctggaaactaatgttgaactatatgtaagattgtctgtagcaatttgatagaaataatgtttacctataaattatttttaatagttacaatttaaaaaaccctctgaaaaattgataccttttcctaaaacattaatttataaatatttatactaattaaaaatagttgaaaaaaataaaaatcacaaaaaaatgagatgaagttttaatactgcctttatcattatcaaaaatgaaagagaaagcgtaggaattaattggacaggttttccaattttatttactgacaattccatctgtattttctgcaattcctcactaacagatcacagaatcttgggaaatgactgattccatatctaggacaggaaatgtgaaaggcctggctcggtatcagcctggttccaacagagggacaaaaccacatgatcatttgaaacgaggaattctaatagaattctaagctataatatcagagcaatcataaagatgtaaggagaactctaaagggtatcctgacgctctgagaaaatatcagaggacagccaagcgtgggcggaaagccttctccctgggaccagcttcagccctccttggaggaggtgcagctgcagcataccctatggaagatgttcacaggttgcctgggttcacattctaacccacattcttcaggaaagaagaaacaaccctccagggtaccagtgggctggaggataaatatgcaggacttggcgctcacctcactgcgttgccaggtctggagcacagtgtttacactcggtgggggtggggggggagtgggtctcaaggcggttgtcatgagcccaggcggcagttgctggttgccaagtgcctgtacatttggtacattagggtctgtatgtgcgtctggggaaaagcaccacacaaatccccacacgtccagagagctgaccatgcagtatgacaaagggaaaagcaaacatgccacgtactggatctaggaagagaagtcttctcctgcaatgttcatccacagccctctactgacaaggctcaaccttgcactcaccgtaaaggagaaaagctctccgggggtgggggcgggggggttggggggcgtaattcctgtgcacagcgcaggaccttgttaagcaggtattgaggcatgaatgtgcgccacgaagcattaaattgatcagtggcagagcccagaacatattgctgtaccagaaaccatgtaagcaatcaaagactaacatgttgtctaaagtacacagaaactgacatgaatgtgtgaggatctatttttctaaacattctttgtcctttttataattccttttgtgatgtagatagcttatttttttctttatttttatttttttcctaacttgtgcgtgtgtgtgtgcacacatgcatggacacctgtaaatattttttaaaacaattattgcgctgctgctttggaactttgaagaagcctggtcctttttaaagagtagtgtggacaaagaacacaaagtttcagttagacaagaaaaataagtttaagagttcgattgtacatagttaataacaattgactatggttaataacaacatattgtatacttcaaaatttctgagagtagattttaagtgttctctccacaaaaaacaagtatgtaggtaatgcatatgttaattaacttgatttagccatttcacaatatatgcgtgtatgtttgtgtgtatatatatatatatatatatatatataaacatcatcatgcaccataaatatgtactatctgtatttgttaattaaaaatatttttaaaaataaaaataaagagtactctagggaagtggaaacagtgaactttgttttgggtttcttaatagaaacaaatccatgctgagtctatcaccctatgcacatactcttcttttagtttctggtataatgaagctttttatttcttaccaacagtctctaaattgtgtgtccttcatgttttattctgccccaattttatttttagcaattccctttcagggatctcaggctgagattatatcaaagaaggtgccacctttctctttactatcattttctcattctaaggtggagagctgtcaaagtgtttttccatttcgtttgtgccaccaagttccctgcttgaaacctaagaaagtatatactggttctggattttctcttggcttaatccagaatttacattatttaatttatctgacacgcatatttaacaatttgtgtcctaatggtgtagacatttccttattttggtgattaactgttccttatgtttaaacattttctctgtttacttctaaatagaatgctcttcagagtttccttatcagcaccacttaatattattgttaagattatggtgaacctaatcaaataacttttactaccctttgtaataatttttaaaaactacttatacagagatattgcattaaaataattacggttcatatgcacaccatttcagttacatgagctatgccttattacctttgaaagcatttttttttagagattgcttcattggttttagtgttcatacattaatatttcacttctaggaaggaggaagagattaacagcactttaaaaagtttttagtggcactttgggaggcatatattaatgttaggtgtttggttttaattgtattaacaaaaacctacccagtgaatttcaaatcagaaatctcaacccaagtcagtctgactctatgatcaacactggaggaaacacaacagtcttgtgcttgtgatagccataattcctggattattaaaacaaggcatcttaatatatgagaaagtatctactataatgttatatacattgacagccctcaaaccatgtgtccactgatttcaatttgtaaactatcatgtatacagcagggtgggaggaaattgttggcttctccttggatttaaatggaggaacatgataggtagccatatatcattctttcagatgcttataggactgagacagacttccagaatttgacagcgacatctgcacgtcccaaaataattatttcatgatgtgtgacactctccttaagggaaattgtaaaatagggctgaccaatgtcccttattttgagtttgaagagtgcatatcccaggaaggagtttggaatcagtcaaattgaccttccttttatttttgcccttaaaatcataaatagcattctttctgaatagagaaacagaaaaacttgtttttcatatttttagttgtgtgcataatctaaagagagctagtctttatgattagcatggaatatggggtaaaaatcactatcattcttggagacagacataaattttaattctggcttacctattgctacattatatgatgttgagaaagttccctaagttaactaaactttttaagcatagtatacatatatgtacatttataaaaagtattttatttcatagctttttccataaagctttacatttatactttaagcagggcacaagaaaactctatgccattgcacccaatagatatttctctcctcagtagagtttaagactgagaatacttttacagtacattgcaataaacattagcatttgagtttcctttggatcagttctacctgtttgtagataatggtatttcatttttgtggttgttatagaggtacttcaaagaataaacaaatattaacttatttcaaatttaaaaattatatcttcaatgactatgtgggtatgtagacacttttataaatctaggatacattatggaacttagtaacatggtggttttaaatgccttgaatattatcaagatacttgtcttggacattttcatgatacatcatcatccaaagaattatttcatcattgtgcataagtttttttcacatatatatttaaaagacatgtaatttgaaagattgtgtattgaaagtttgtgtgaagaatgacaataatgaaataaatcttcactatttcatcattctttttttttaaaattgtgttgctcaaagtattacatcaactttgaaaaatatataaaagaggactggcacaccatcttttagtttcatttctattttcattgactatacatgtccagtaatatttgaataagtgttataaagataatttcaaaatcagggatagtttccaagaattagttttattactgaatatataaatatgtatatatatatatgtgtgtgtgtgtgtgtgtgtgtatgtatgtatatatatgtgtatggcaagcttaaatattgaatgaattacaaataaatttttttaaatatctattatatattggtgcactcaggtatacatatatattaagttttttagtataactaacaaatactacttagtaattctattttgaactatatccatgtggttagtattgtcatttttgcttattttttcatatttacaaaacatacaaaattgtttttccaggttgcatgtgaaatatatttttctgaaagcatatgaattgaatacttttcatattataatcactatatgtgcatacatatataactatggaataaaatcaagaatctctgctgtcataaatctagtaatatattgaggaaaatacgaaaatattaaacagaaacggccaagtgtggtcgcttacgcctgcaatcttagcactttgagagtccgaggcaggcagatcacgaggtcaggagtttgagagcagcctgcccaacatggcaaaaacccatctctactaaaaatacaaaaaaatttagccgggtgtggtggcgtgcgcctgtcatctccactactcgggaggctaagacaggagaatcaatcgcttgaacccgagacagggaggttgcagtgagccaagatcacgccacttcactccagcctgggcaacgagagcaaagctccatctatatatatatataaaaaacagaactttgtccaattaacatacttaccacatgggacatttacagaaataggtgtatagaagatgcagtaaattaaacctattttttttaggcttaaaacaggctaataaatggataatctaaatacattcatatgtacacttcatatgtacatgaaatgaatgaaataatttactatactggtactagaaatatgaaatataattataataaatataaaccataattttatttataataattctagaaatatgttacatctaatatgtaaatttgatatatatttattagaaaattataaaattcatcatttcaaaaattatttgtattttaagaaaactggtgtgccacatttaaagtatcatttattagatttacatgttattatttaaaagttgcttgttatatttgtcaatgtgtctaagtaatcagatgtgtttgaaattcttgagaacattagctatgtccaatttctaaatatataatctacttatagtaccacgtttgaagaaaaatgtctaagctgaatttctgcaggagccatgggtccaagttcacgttcattctgtttttgtgatctcttctaccctatactgtacgcccatacatttctaaaatagttcaattttggttctagggaaagtgcaacacaatagagagcctctgaaatttttatatccaccttttactttcccaaatccttgggttctaacccattagaaatgagtgctttaaatttttaaagtcatttgtatatttataacaattctattactgttttcaaaaacattttggaaaatatttataggcaagatttgatcattatttccagtgaaatcacattcaaaaatacacatagcttaatgaaattcagtcatttcaagaaatattgacaattttcactatgttgcagtttaataatcagtaacagttaagatgtacctatttcttaagatatgagtattcctcagcatagtagctaattgatcaaatataactttggttactaacatttattgaaagagaaatataatttctgcttttgtaaaatccaaatggtccctgactagctttgttgataaattcaaagctacttagaataattgagttgatagtatctgtataactgtttagtatcatgaactctagactgtaaaatttttgaacattagtggacattttttaaagaaaaacagcttatggtatttaatagtcttctgtgtgctctaagaaacctgataattatattagtttattatgtaccagagcttagaagtacacaaataacattctaacttaagtttcacattttacaaataaaaaagtgagcagcagataagaaagtgtgtgaaataaattgtgaagtaatgataatgtatttcaaaatgagtatgttctcataagtgtttacatatctaataatttgtacaaaactcagttttatttgtgttgctatacctggtatagcaattaaacgctacgaaaaaacattctggtgtattttccctccatatgtttatgtttatgtctcattttacctttacctgcatgatgaataaaaaaaaaaaaacttaaatgtgactaacctatagaattaatttttttaattgtattggcaaagtataaatgaactactgaataataaatatactataaaagtaaactactgaatcactatcgttagcaaatttttaaaaacattttaggaatttgaaagtagaaaacttgaaatttgcatgcttttaaaaattaaaataaaatattattatacaaagctcacaacataaaagcatgtaattaatataaatagaataaattttttgatgttttaaaataagatgaatgcataacaaaaattattacatattataaagcttattttatatatataatttgtatatatattgaatataatataatatagaattacaataattatataaattataatatatgaatattaaagatgttgatatctattatataacaatattgtataatatatgaagaaatttcatattatgaaacaatgatatattgtttagactttgtaatttataatgagtccttacctgaccagagcctgcattttcacaaacataagtctcatagtattgagagaactcaggagcatgatcattgatgttaagaacttgcacatacagtgggatcgaagagatctgttctatattgtctgcaatttgaatatatataataaaaatctaacatattttaatatgtctttagaagagacatcattaaaattacattagaggctacgtggtgtatttttattttacttgaaaaaagcaatctgaggacaggatatctatatgattcacctacttatcaacaatagatcctagaaaaaaattccatgctcaatatattcaaaccaagcaatatttattgagtgcattgtatttgccatgggctgtaataagtgatgagaaaaagcagtaaaaagataaagtaaaataagggtatacggagagcttgcaagagtccaggaaccatttaaagttttgtattaactcatttaattttgatcaatatatggattattatccccccaattttacggataaaaaattgataaaccatttagtttcaaaaattacagttaaattacttgtgtaaggttatagctgcagtgctataacaaaaaaaattctgtgaaccactgaaatttagggcgtagcttttaaaaacaaataattagaatctaaatatattttaaagtaaaatagttataataaaatctaaataaagtttttatataaacattgaattgagaagattttctaagtgagccaagaaatccaaaaaacataatgagagaaaattgtggttaaaacatttaaatctttcaaattgatataaaaaagacatttcagaaaaaagtatgaagtaggaattcacaggagagaaaattcgatttatcttatagcagactttctcactgctgtcactattaatattttatactggataattcttagttttgggagattctcctgtgcattgtaggatgcttagtggcatccctgacttctattccccgaatgtctgcagcatccctcccatcccagtgtgtcaatccaaactgtattcagacattgtcaatgtgccctggttgaaattgggggcagaagtgtggagccaaatggcctgtagtggagacacgccgcgttatcataatgttcacacagcctctcaccacaggtaagaagaatgatggtttagcccatgccatttttgtcatatgcgatagaacagcacccagtgatagctgagtgctgaaaaataacaatgtaaaccgactctagcaatggataatgaaatttaaactacacatatctgtgacccaatctgttaaacttaagctacagtctaaggtatcagtatttgagtaaatgatccgattaaatacattccagagttatttgcattacatccaaattatataaacgactcaaatgtacaacaaaaaagaattggggagaataaattacaactgaactatgatattatgtggatttattaaaaatttgtgagtctggccaagcatggtaactcacacctctaaatcccagcgctttggaaggccaaggcaggaggataacttgaactcaggagtttgagagcagcctgagcaatatagtgagacctcatctctactaaaaatccaaaaaaattagctgagtgtagtagtgtacattgtagtctcagctacttgggaggctgaggtgggagaatcgcttgagcaggaggttgtggcagcagtgagctgtgatcgggctactgcactccagcctgggctacagagtgaaaccctgactcagataaaagagtcaatgtaacacatttttattgtgagctctaaaactggatgacttgagtttgaatcttgtttctcaatttgagaaaaatacttaaccagaatgcctcagttggcattctgaaaaatgggtgtgatagtagtacctgccttatagggttgttgttaagattaaacatatacataaagcaattgcataaattacatgaagcaattacacaaattggttaatatacataaggcaattaagagtacttagtacataactgaacaatgaatgttaaatattattgttttgttgcatctactaaccagacatgtattttgtgaactgaaaaaagtaagttgcagctattatattgtgtaggtttattgtttttaatctttctctctctcaggctgtagtgcagtggcaggatcccagctcactgcaacctccacctcctaggctcaagcgattctcctgcctcagcctccctagtagctgaaactacaggcacatgccaccaggactggctaattttcgtatttttagtagagacaggcttttgccatgttggcaacggtgatcacaaactcctgaccccaggttatccacccaccttggcctcctaaagtgctggaattacaggcttaagtcatcatacagggcctctctttttcataaaaaaaaaagaaagctataggaaaggtgcatacaattaaagggtataggagtgggattctttagtttgttttagtgtttttatttaaaatatatgtactatttgcaatgataatttgaaagaacaaaacaaattaaaaattagaggccttgtacttgttgaaagcaagggaaaatattttttctttccttccttttctcagagcattcatacacacacacacacacacacacacacacacagagaaagagagagagagagggaaaaaaaaagctttgtatgtaagttttttctttgtccctttgaagcgtatggaaatctttcaaaagttcaacaagtttcttggaagctttaggatccaggattgtatttatcaagtaatggtgaccatctctttgaaatgtaatcttcaaggaatacagcatccctatatcctagatgtggggaaggataggagactcattttagcaacgatcttgttctaagttgtagaactacctcttgtcataaagacatgaaaagttaagttgtcctttggataaaaccacttagcaaatacaggcggtcactccaactacccagtgaatatagaatgaattctatgtgacaaatagtgctaagtcctcatacttgaatatctagataatatttaacttgagaacatgtatatattggattgcacctgcttgaccacataaaaaggtgagatttctttccattttggcaatctcttagatttcctatgatgcagatcacattgtgttttaatgctttccagtaataaaatttttctctctgttctacctttgaggggaggttttctgggctgggatgagattttgcttaaaattgaattttcccaacaataacagttacaattaagatagaaattgtaattttcaattaactaaaaattaaaatttctaggatttattacacacacacacacacacacacacacatccatggcctttaagaaatacagcaactattagtatttatcattttgagacttttctccattgtgtgacatttaggatgaaaataaattaatggaacatttaaaaatgaaaaggtatttctaaagatttcaagaagaaattaaccagaaaatttaggttcgtatttgttatggtttcagcgcatacatcatcacagaatatctttttgcttaaataattaaattgtataatgtaattcagttgtgaataaactgacagaaaattaataagaaattcataatgtttttatctttgtgttcctaaactttgcttgaaattaagttaaattaaacctttggtattactgcacaaaatgtatataaaacttcacagcttcaccttaaaatagtagttttattcacttagctagcatactgataaatagcattgtgcttaatttgggaagctttccagaaaagagactaagcacaacgaacttcatttgctggaaaaaaaaaatttttaaatggaacatctctttcctataatcagtataattgctatggtgaaagcttttcaaggtagttagcaaatgcagctagatgatttttaaaacagttttatgtaatgccctgttttccaccagtaggtggtttgtttatattgctattgaagcttaaatggtcaagcctaattatttttggttcaatattgatttcacagtagtaaaaaaatggcagttacacatattttccccaaatagatctaaaatgggcttaatgatgtagaattttttaaaatgttagagaaagaaaaaaaatgaaaatttgttatccagtgttataaaagcttgttccaacaagtttttccttaaaatgaaaaaaaaaaattgttctcagaaatacacaatgaataaaagctgcatttaaaataaacatctttgcattttctgacacgagaagccttgacatttcctctgttacagcgggcatttattccattgtaacatttgcctccttttatggtttagttaaatggaaccttgaaaacccagattcaagctctcctacagtgtttccatagaactgttcattgtatcgcaaataatatgcggagatgccttccactccaccatatcacctgccatctgcctgataaagtaaggaaaagagagatatctgctccctgcctcaacaaagagtgaagaaaggaaacaggattattaaaattctatgtaaaatcagctataagaaaagatgcatctgagaatattttatatttgtaattttaatactttacaattctaaatctattgactaagtaatggaaatgacttcgatattttatattgtgttatatttatttctttaagctttaataaatataattgtatgaataatggattcatgattttaaggacaatatccaagtggtaaatcagaaaaatttacaacccgaaaacgaaatcatccacctaaataaacaagcagaatttcaggtgaatttcatttgtattttgttgtttcctcaatttattcttgtatggaaaattatttactgttataattagaaaatagtttagaaggtatttagtggtaagcatataaataaaaactaataaaatacgcaagtacacacatttacattgaatgtcatttaaataattccaacaacattttaaagtagccttgtccccatgtatagaaatttgtaattatttacaaaatatggcaaacaactgtattggatttcaaatgagtacttacatttttctgtggctgtaatacttaggttgtaccaagcactgatttcacgatccagtgagttacttgtagtgattgtaccattatcattgatattgaacactttgctcctagtaatagaatacctgaaccaaaaggaaagtataccttaatatttttattctatctgcataacagtgttagataatactctttaagcaataagacatcttattcaatgcatgctctacatagccaatatataataccgaacaacttttaaaacagtatattcctgtatttaagattcaactcagtggagatagaaaaaaagacgtaacatgactttagatttaaattgatggatgctaaatctaaaattaatgattgtgaatctttttttcctatcaaataaattaaaatatatcttcagcctagacgagtattgatctctttcctatgtcacaggtgttgcttgcgaatctgttcattttactacaactacttggcttgatatttaacaaatgtttttgtttgtttaaaaagtaaatttgataaaaagtaaagtctatatagtagatagaattttaattcttttgggaaacctgaaagacttctgaaatctggaatctggaatcaggaatccaaaatatttatatatatatatatataaacatatatataatacattatatatgatatatattttacattttataacacatgacatattttattacatatataacatatttgtaatatttaatacatatatgctttattctatattacatatagaaaatatgtaatacataatacatatatgttttatgcatatatatgtaatatatgatacatatgttttattatatattacatacaatatatgtatgtatatatgtatgtgatatattacatcacatgtatttattttatattatatatttttacatataatatatatgttttatatatatacacacatataaaacaaaagtaaaatacagtagttctaatgtgcttttagattgtgcatggaagaaagccaagttacaaatttctcccaagggaaaaaaaaaactgaaaaatgatctccacctccacaatgaaagaagacttcgaaatactcagcatgtctcatctatgtggaaacaattaataataaaaattaaagagcaataataactagggttcaataatggcttctcattgcatgtatattcctgaagactttgatgagatatcaaggaagtttaccataattatatggcaaagatgagaatattttaattttgagttcaagtatttccaaaaacattatgctactttgtagctaggtattcagataaggactcaatagaaatcacgaggaattaagctttaggggagttcagttttaactgtactccatttaaaatatttataagtattttccctaaatatccccaagtggttgcctttcacacctaatagaattgttggaaaaattatacagtgttttaacagttgttattttgaattaaacatctaatcctatttctgtaaaatgtcattgcacataaagcccatttaaagtttgacaggatgttatagtctttagtagtttaattcacatctgttagaatttaggaagaagagccacataaacaataaattggttcagttcccattaattaattaaaacagaagtaaaaatatatgtagcccctctaggatgtgatataagcagtgatgtgtaatatgtatcatttttcttaaccccttttagaaccacaaattctcgttatgtaagttttcttttcccccactccaccttcactggacaaaatttgtttggctttgaggtaagttttagttaaattttacatatatgtaaaatacatatatatatttttcccatttttaaactagggagacaaacatcagaaaattcataaatatgtaaacagctgacttatttagatatgtaccatcatgacctcagcaaaatttaaaatttggaattttcccactaatccaattaaaaacattttacaataattttggacttacagaaatgttgcaaaaacagcacacagcatttctacatgctcttcactcagctttttctaatgttaaaatcttatataaactttaatctgtttaataaattaatcgctataatttaattaatcaaactacaaactatagttggatttcactgttttttttccactcatattcttcttttacaatccaatgtagaatccaatacggcctttcattttcctgcgtccttagtctcctccacgattcctcaatgttcttgtctctcaagaccttgatgctattgaagagtattggtcaattattttaaagagcgtctctcaatttgggtttgtctgatgctttctcatgattagactaaggttacatatttttggcaggaataacacagacatgatatactttcttaggctatcatatcaggggaacatgatgttcatcatatctcatgaatggtgatattaacattgagaactcgaataggtgatgacgaccccatttctctggggtaaaattgctatttttttcttctgtaattcataaggatctcaggaaactattttaaaatgttctggtttctcaaacatttatccactaattttcagtatccatagaggaataatgttaacattttttaatactttctttctggaaccacaagatgctccaggatgatcttgtcgtttccttacaacagctctggattccagttatcagatgagttgcagcatctttgattggagagtagtattagaaagcaagatctaggtattaagagttcccattgcttcttgagtttcattgtttttaggtcctttgagcagacatcagcaggaaatatatgtatgtatacccatgcgtacaaacacatctatatttatttccatgtaattccttctgtctgtatatatattaagaaggcattcgtgcatcatacctcagatttcaatccagtgtgacaccttcatgtaacttttctcattttttatttgtaatcatttcttttgacaataatgcatcttagtcttactatctacagcatatttacttatgtgttcaatcccaatatacatgtagagtaacactgcaatccctaaatagtatccatgtaaaaaatatattcactatgtagagtacatttcttctgaacagctatttttttctctagatttagaattgaaatactctcttccaaaattacttaggttgtattttcctaattcctctccttttgattatgttatttgtctataatataataaagtacatttgcaatagtttgccttcaattttggggatatctccaaagtcctatttgatttttttccagagtttacactaattagtattttcatctatatcttggagaattctctgaacttggacaaaagaatagtcatgtgtccgccttcacataatgacacagaacaattttatcaccctcctttcctttgtcatatctttttagtttaggtaccacagggtttatttttgtttgttcattttttttaatccactcacctattgaaggatatttgagtcaattccagttattggagatcatgtataaagctgccataaatgcttgcatacaggttttcatgtcaaaataaatacactttctaggcctgctgcaacaaaacaccacaaactgggtggctgaaaacgataaattaactctattagatttattaaaatcaaagtatcaacagggtcatgcttcctttgaagcctgtaggggtgaatccttccttcctgtttctagcttccagtgatttccggcagtccttgctagtcttccacttgtagacgcatcgctctgatctctgcttcggttgtcacatggcagtcctctcccagtgtctgtcttcttataaggacaccagccattttggattaaaaacatacctgctcaggtatgaccttatcttaactagttacctccacaattactctatttcttaacaaggccacattcgggtgtactggatgttaggactcaacatgtctctttaggacacaactcaacccaaaacacaaagtttcctttattcctgggtaaatgcttggaagagggattgctgggtgttgcggtcaatataagtttaatttataataatcttgtatctttctgccttgataaactcacatattactgggcatttttgtgaatttcctggaattatctaggcaataatcaagtcatctgcaaataaagaaaactatattatttctctccagcttgtatgtttttatttctttttctcacttactgcatggccaggacttccaatattatagatttggactagtgaaagagtacattcctaccttgtttccaatcttaggaaaaaagcacataatattccataattaagtataatattagctgcattcttttgtagatactctgtatctgtttaagaatcttctattcatattgtgctgattgtgctgatagtttttataataagttaattttgaatattgtcaaatgttttttctttgtctattgagatgttatatggcttttcttttttaatctctcaatatggtggtttatatgaaactattttaatatatagacacatccttgcattcctgggtgcactccagttgataaggatatactttccttttcacaaatagctcaaattactattattgtaaagaattttcatatttgtttatgagggatattgatctgtagttttctttgcttgttacgtatggtaggatatatcagtggcatcaatttttactggaactgctctttttttatgaagctatttaactgactttttggtggtatatatatgcttgtgtgtatgcatgtgtatgtatacatatttatgaggttgtacatatatggttgtttgtaaatgtatacgtgtgtgtgtgtgtatgctaaggttatttatcttttaatatctttggattctctcaagaacttcctctaaatgtataggcatagcattgttcaaagtagtccctataatctttttaatgtctgtgggatcaatatgtgtgctccctttttcactttggtaataataatttttgtcttctctctctctctctctctgtttgccccttggcctttctcgatagagattaataaactttagcaatattttgaaagaatctgctactggcttcattatattactccgttgctttcagtttcactgcttgtgatctaatctttttatttcctttttgtcctgcttgctttgctttttatttgctcttttttttctaacaggaaataatacaccatctttctcatacttacaaaatatttcaaagtttgactttagacttaatttgaaaggaaacttcaataacgtccaaaaagtaaatcatacccattgataccaaaagagtaatccctatatctgaagtccaaaagaataaggcaattgtcttagtcatcacagacagctattaaaaattaccatagactgggcagcttataaacaactgatatttatttgtcacatttctagaggctggaagtatgagattatgatgccagcatgattggcttctgacaagagcactctttcagttgcagactgttgacttctgtgtccttacagccagagagaggcttgagagagctatctgggttccactttaagggcactaatcccattcattagggctccacctgtgtcacttgatgccttataagacccaccttctcgtacccacctaataccatttcattgagatttaggatttcaaaatgggacccaccttgtaataccatttcactggcatttcagatttcaaatatgaattttgagggacgtaaacatttagacttctgaaataatacatagtcttagtgataaaataaaaattttaagaataatttcttatgaagttcttaataattttatggtagtaattttattacagattgtttgggctcctctaatttttaccatacaaggctccttaaaacaattctatcatctcactttcaagtctaaatattaaatttttccattatttctgtgccccattttttaaaaattgacatgtagtttgttattataattcatataaaggtagatcttgctcctcaagcttttatgacctcaactaaagcaagagtatttcgttacaccagtttatttaccccacccaagacgtgatgaaactgagtttgggaatttccatgctttacagaaacagcaggtgattcttacttagtaggaaaaactaatatgagttgaatgaattggggctaatttactatgtttaatatgtgttagtgtttctcccacaacaatgagacatccctaaggctaaaatacaatatcctaatattttttctggttttcatagctcttaccatgcagtgagtattaaagaagagatattatcaaattaaaactcaaattgaaatcattttgcattttatgttcaaatattttggggatcttttgcttacaaagaaaaaagagataaataaagaaaaccaaaaagaagcctcctgaaatgtgctgaagtgggtattttcataagcaactgattttgtttttatgatgtattttgaatgtttgttaaatcaagctatatcatatgaaaaaaatcaacaatatcaacaacaaaaactgctgtatcctcagtgatcctaacatatgtatgaaaagcaatattatttaaaagacacttttaaatgaaagaacatctgtcaaatcattaaaacgtgttttttgatggatacaagttattttaaaaagtaataattgccagtataaaggtggaagtcattagctaaaatattttcagattgaagtaagtagacaccaatggtgatactataaaatacaaaacctcttaatatttggttgtaccttaggtttttcttcatatatatgtagcattttcacatgtagtaagcatgcaattcttcattgtgtattattgtgctttaaaatgtatgcagtggtattacctatgcatcacaagcatcatgaattataatttactcacttgtactcctaaaattaacagttttcaatactttattactataaatgataacatatgaatatcttaatcatcaaagcattttttaacattccatattatttagtgttccctgaagaacaatgaataggtatacagatacattttttaaagtaaaaaattgatatgcacttatacaatcactaaaatgtctatgactaattaagaactacatatgcgtatcagaaggcaacattttatgaactggaactataatggaaaagtgggaacatttcttggtatcaaaaattaaattgagctttttcattgagctactgcaagaccttcacagagccaaggagcagctagcattttaattaatatatgaaggtttctggaaaataggtgagtaaggaaaggtgttggagaaatcattacgtaacaagctttggttttttatgcccaaccagactatacctcaactactgaaacaaacaaataaacaaaatataaaacaaaagcaaaataaattataacatagtaactgaaaataacagactattttaatagatggcaaatatctgtttaattgtaatacaagaatagatttctaaccctttgaactcctttaagtggtatcctgtaaaacacaggttcccaacccccaaggccatgaacagcaggccatgaacctgtccatggcctgtaggtgagggcaggcgagccagccttactgtctgagctccgcctcttctcatatccacggcagcattagattgtcataggagcatgaatcctgttgtgaactgtgcatgtgaagtatctaggttgagacctccttatgagaatccaatgccagataaactgaggcagaacagttttattctgaaaccattccccttcacccccccgaccttggaaaaattgtcttccaccgaactggttcctggtggcagaaaggttgaggaccactgctataaaagctttctcaatttttgaatatcatttcaagtaaatagtatttaaataagccacttttttgttgtcgttgagacggagtctcgctttgtcacccaggccggagtgcagtggtgcaatcttggctcactgcaagctctgcctcctgggttcacgccattctcctgcctcagcctcctgagtagctgggactacaggtgcccgccgccacgcctggctaattttgttttgtatttttagtagagacggggtttcacatgttagccaggatggtctcgatctcctgacctcgtgatccgcccgcctcggcctcccaaagtgctgggattacaggcgtgagccaccgcgcgctgccttaaataagccacattttgatcagctttgtttcagctctaattggggctttttaaaaaacgattgttttcctcttatctcctttccccaattaagagggaatataatgcactgaattttaattggtaattgcctccttcttgcacgtgtttgaaatcaccaattttactgcatcttaaccgacactgaggttccctattttgcttaaattgttacaaattaattaagacatacagaaatatagatacagatataaccttgtttaaatttgcacgcaggctaggggcggtggctcaagcctgtaatgccagcattttgggaggccgaggccggtggatcacgaggtcaggagttcgagaccagcctggacaatgtgatgaaaccccgtctctactaaaaatacaaaaattagctgggcgtggtggcgcatgcctatagtcccagctactagggaggctgaggcagaagactcgcttgaacctgggaagcagaggtggcaatgagctgagattgcgccactgtactcgagcctagaagacagagtgagactccctctcaattaaaaaaaagattgcatgcaattttatttttaatctattttatatttacttatttattaatgcaaaactgaccttacagacatacctgataggagatttcctattgtctgggtctgtggcagacaccacgcctacaaatgatccctgtggggtttcttcaaaaacttcaaatacataatatggaaggaggaaaagaggaggctcatcaacatcttccacctggatcttaatgaaagtggtggaagcctcagtgtggtacttcatgagctgctcaggaacatgatggtttttaacttttgctctaataccgtagtggttctggtgctcaaaatccactttctgcaaagaaacacagtatacacaaaagaaatggctttagtaacccaagatactatttagaaaaaaggttttacctgttaaattaagtctcagtggcctttcagttagatttttctttttatgtacatggatctctctgatataattgttaatcaggcataacaaatctgggtgtattgtcacttacctattttaatttggagataaagttatacttttgaaagcataaacatctaatgaaactgagaattaatttcctagtatttaagatattttccaaaaagttttattattagaattaaaaaaatgttctgcatataattcaaaacactctgtaataactctctcatctctaaaatccttgtctccataaaacataaattactggttctcatttcaattatttaatgagttaaaaactaaccagctacacaaaatatgttatgttttaattttgcgctattctgcaaggcaaataattttaacatgtctaccttttttaatataactattccttcttgagtttcatgattagtaataatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtatggctaccataatctgagtgggatcactaattcttctaattcttcaaacagtggtgtttatatcgaataagcaaggttttggcttgaagaacatgaaacctggatgtgtgggtacatgagatgggaaaatctgttggaaaaagaggttcagaggaggggcagctggaatcaggagttcagttaagtgtgtgttaggttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggttttaaatgtgtaatatatatgtgtattatatatgtaatatatgtgcattatatactatatatgtgtattatatatattatatatgatatatattgaatgtatattatatataaatatattatatatttgttatatattatataaaatattatatattatatataatatgcatttatatgtaatacacatatataatatatacaatgcacatttaaaacctaatatacacttaactgagctcctgattccagctgccccctcctctgaacccctttatatatatatatatatttttttaaaaatatataatatatgaagttgatgagtagacagatttacttttgcgaagctcaagggagaagttcagtctggagatgtatatttaatatgaggttctcagcccagaggtggttatgtaaagccacgtgtctggataagatcataaaggaatgagtataaaagggaagaaagacgagatcaaaggcctgactcacaaatgttccgaagtttaaagtatacaaagaaaaggcaaggaaggaaaaaacagagactagtaagacagaagaaaaagctaatgagaatggagcattaaggttttcaaggagaagttgatcaattacataaaattcttccaagaaatcaagtgttatcagaactgagaattgacactgcattccacttaggttattgatagaaatgatcagatcagtttggtcaagtagtgtggatgtaactcaaacggagtaagttctgagattttgaggtcgttaattggaaacaataagtatgaacaatattttaaataaatcttctctaaagagaaaggaagaatacaaagcatctttagctaagtatggaagtgaaggcaagaaagtgtttttgttttgtcttgttttaggatgtgagaaaaaacaataataaacatgtttcgatgtgatagatatgaaccagcagaggacgctgttcacacaagggagagggatgtttgagagatgcctttaattgggagggtaggaagtgttgcccacaacagagggtataggtattgagtatttacattgagaggagggtaatgggattcccacaagggaaaaccatgtggacaagagtaaggaggccagaatcagattcacccacactcgtatatgagtgaaagtattaagaggaataccatcatctcatattcagacttgagtaataaagataattttaaaagatattttaaatattctaatttattcaaaatattttaatattaaagtcaggaaaaatcagagggaaactgagaaaggtagtagaagcttcaggatattttatcgcagcaagttccttgggaattttcctgtcttccagagtcttctacttgctatttaataatcatctgcataaatttagaccaaatttatttaataaatccagacactatttcccacatattatatgccaattattttataaagttctgggtatttcatatttaacttggtgttctcctcttgccttcagaggccatattaatgttgtggacagaagacaacatatgtatcatatacatcatatgtgacactacacagagagagacgaaggtgcagactctgacccctttgcctatagtccatccacagaggaactgttttctcaacccatataacagtggtaattttttaatatgacaaaatttaaaattgtgagatagagcagaaattaaaaaatgagatttgtgatatttattgaaaaatcaaaagatctgataaccttgcatatgttggctacactgagtagttgtctgtatcatttaggtgtgggcatttgtgtgtgcgcacacacattaacagatattctcaagtctgtacaactaatgaatggaaaattcagggtttaaaagcaaatttgtatgatgccaacttcctgtgcttattcatggactcaactactggaaggaagtcagtgaaagtagcatttcacttgggccattaaaaatgacatgatttcacttgactttgaggaatggggcaaggaacagaaaaggatgaggaaaaaaaagtaatcaaaagatagttttgtttctgtctataaacaatcaataactaagaaatcatgctatggtatatatttttattggctcttttctttgttccatgctaattaaattttcttcctagcatgataattacttatgctttctggaagtgcttataaatgtattcctgtagctaaaacagtataacctgaaaaataaatttcctagaaaagaaattcctccaataattgcataagaaaattttacgaagcataccatgtgtttatgtttagcttgcagtaattgcttaaattattagagcaggtgtggcctattctggcttataaagtaaaaagaaatacaaaaagtcatttttaaatgattatctatggtttgcagaagaaggaccccacaaagatatctgtgtccaaattcccctgaacgcataaatatgtcaccgaaagtggcaaaagagaattaagtttgcagatggaattcaggttgctaattagctgaccttgagatgggaacattatcctgctttatccaactgggttcggtctaattacatgagtgcttaaaagtggaagaggcaaatgtgtgggttagagggttgtcagtgtgtgaagtatgtgacactccttgctgcttctgggatgtgtgggctaaatcaagagccataaagaggccttcaggaattaaggatgtctcccagcttacagccatcaataaaacagagaccttaactctatatacatgtaaactgaattctgctaacccttaaatgaactaggatcctacagcaagaaatgcctccctgaatcctttgatcataacccaatgagacccataatacatttgttttaagccatgaagttagtggcaatttattacagcaagaatagaaactaacacattattctttcatttgtatttaacatttaacatgaattaaaataatcataccagaacaattgacaaatttattttatataattttagtgttaatgtagtgcttttagaatgaaaactatataatctacttatatttaacacactcatatttataatgtaatgaagatgtagaatcctttttacttactttctttaaatataggcttattgtcattaacatctgaaagtttaattaatacacttgttgttccagacaacgctcctggctgaccaatcatgtccttggcttgaatgattacccaatactcatcttgcagttctctatccattttagaagatattcttatgactcctttaaaaatataataaaattccaattatttcattattaatcatgacaaagttctagttaatttcttaaccattgcagtatacattattttgctatatgttgaaccactgcaatgtgacagagacttcactagagaaaaataataaaaaataaattaaacatcaacactgcctagagtctagagtgatcatcacaatattaggaacactggtaggcccttaataaaatactatgttaagataatccacaggtagaaaaaaaagaatgtcttgtttttactttaacctattttctgctatctcttctaacataatatcggcttgctacagttaactttgtccccgaaactctgaagttagtatattattgatagatttgtaaattataataccaaatttatgaaataaatgtcatgcccttattattttgaagtctacttagaattatgagatctgaagaagacctggttgttgacccagttattttatgtgtgtgtgtatacacatatataatatattcaaactcaagataattaatgataaatattgcaataaatgcttaaattctataaaattatttaatatacatttattaactatcactgaaaagaacctaagaaaatcttaagacaggttcataagagaggactcaacatttctaaagatttggggaacacataaacagtcacaaaaaataaataatacccaatacccaaatatatcaagggcaaaatattcattaaaaattgtgatattaatgaacataaagatggaaacaatagacactcaggactactagagaggggaaggagggagtgggggagatagttgaaaaacttctgattgggtagcatgctcactacctgtgtgtgacgggatcattagtaccccaaacctcagcatcacagaatttacccatgtaataaacttgcacatttacgccctgaacctaaaataaaagtaaattaaagaatacaataaacttgtgaaaaaaatgacatatgagtataaaatgcacacctgatttcaaagactgagaacaaaaaatgtgaactatctccatagttttgtattatttgttgaaatggtagtatttttgatttattggactaaatttaatataatataattttttaaagaattgttatatgaacttttaaaagataaattagaccataacatgaggggattttagttgcggactaaagtgtttcacacatgtaatcaattatttgaatccaatggaaagcattcaatatgttgcacaagtgctgctagcgtctccctgtatgtgactcaggggagagggacctaggagtctttgttccccattaactgtgcctactttgctttcaacttttcctctcagccttttgactgaataaaggatatgtatttctggatcttatgcacttcagaacttatgctttcagtaatttaatccatgtttgtcgttgtccataccaacgcttctccagcaatgcaagtaatagtttagctaacctgctcagtatagttaaaaagtcagtgtgcagggtaggggctgggggtggaaagaaaacatggtcacgaaggcctggtatgacccagcatgggtttgtactctagacacctccctttcttctctcttctgcatttctccacactggtgttcagttattctaagagtttcaactctttcccacctcaggaatttccctaatttttcccatgccctgaaatcatcttccactctcccttccttgtctacagactcagctaaactttctgatttccgtgtattctgccttgaccacacaacataaagtcaacctgacttgttttctcccactgaaactttttggttttacttcataagtacctacagtggaatgtatgtgtgtattactattcatgtttaatatctatctgtaagttccaagaaagaagagtccattattatatcttgtttttgttactattatgtattgttttaaattttgcaatttgtacctttataaatctagcaagttgtataacatttggtacatattcagcctttctagacctgaatgtgtgagggaattaaagtctaatgttttgaggcattcattgcatataataaaataatttttcttccatacatttgaaaaaataaaggccatgtacattcctgagagaattaagaacataggtactcaaataatattttttagaatctgactctctcaagaaaccctaattgaaaaaggctgagacattcaatatttgctgaatgaataaataagaaatgtttaaagatccaacacaatactttaattctttaagggttttgatataagctggaaatagtattttccttgtattaaaaaccatagaattttacttctttggcacttctcacgttcttgggtgattagttatatatatatattttttcagtggagactataatcttctaaaggaaaaaaaattacatgggcctaatctttgtttaaaacacaaaaattaatttttgtttaatgaattagggtcatatgattgtttaaagaaaagagaaaactgtgttctacttattttatattcaattgattaatgcagattggtagagcaatattacaaaaagaatcaaatattgtattcatgtaaatcagaaatctgtaaaatacagaattatttttaggtgaatgtctcatatcaatgtgtacgcttagccttatactcagacttaatctcagtcattctgcagggttatgcagctgtatttcattgtggttttagtttgtattccctgatgactaatgaggctgagcatttttaatatgcttactggctttctgtatattgttctttgtcaattgcttataaatgttttttccctatatttttaaattgggttgctggtctctttttctaattcatttaaaagaatctttacatatgatttaaaccacatacataagtaatttgtgctatggacatgaaaaatccagtctcctagaagtatcagctaaaagactaaaagtaattaaatgcttaggaattgcaatctttttgcttattgacatatcaggactactgtaaaacatgtttctaagcagataatttttgctgacaattgccttctttagaatcatgttaaactttgcttgtttcattcacaaatacctgttgttggttcaacagaaaaatatggctggccttgaagtaagctgtagaggagacgagcattattaccacttgagggatcgtcagcatcacttgctgtcacctggataactaatgttcctaaagagaacataatacaggaaattaagattgtggttttattcaggatgaattcagttctgtgaagcggtctttctttaccaagcaagatgttgttacaaaatgaaagctcaattcacctccttgttcttaattgtaaaagtaatgtatttttttgttgttttttatttttttcaggcaaaagaatataacttttaatacaaaatattcctaattcctgtatgcaatatggaattttaaacatgtagattgatggcctaataagatgtagctattaaacaattcattgtaatgtataatttataaatcataaacttttccaaggtgtattattagtggagaaattaaaaggaacttggaaatgcttttcaccaaaaattatagtgtagcctgtaccttaaacaaagtggagaaggttgataaatatttacaaagattattgaattgagcttgaaagagtatccagttgaggataaggatgggcataattattcagctcctttaattctcttctctaatatacctacttcctttgatgaattttttaaaaagcaaagtaaaatcttgcagatattgataacataagcattctcattaaaattcagtaacaagaaataaaatcatatggaataattatgtatacatttaaaattagtgctcagatttttaaaatatttattcaaaaatattgagttttcaaagtatctttctgtaaacatggaattgaatgttatggatcttatttgaaatatgtatttgttgaaacactgtttactgtgtcaataagaatagcaacacgaatgacacaaaatcaaatagcttctgtggttttgtttacaactagcatcatgaattttctcatcgtagcccaattttataaactgatacactctaataggaatccattctatacttcactaacatgaaacttttgctgtggccctaaatagtacatattctttgctcttttgtcttaatatttttataatgctatttaacatttgttttaatatcatacagcatattctattgaagtagaatttcttcttattcacataattttatgggtaatacttttacctgattcaaaatgaatcaggaaaactttttgcctctcttttccaaaacttattgaataaccactcaatgtgtagacacttactagtttcagatgttttaaagtgaatttatttagtaatttgtgaaagtttttccaacaaaatagttaacagggaccatcactttcattgatccatattgcgcaagacttgttcctttaactatccttctatgcaccgatccacttacttatcccacatttcctcattataattctctatcatttctttccataaggggttcccatccctggtttctagaattatatttcctatctttggcttcagatacaatcatcaaaatcataccattttcagagttgactgaaataaattttagtaatatcagtctttagagcccctaagctagtactatacaaatgagaaccaagaagtccagaaaatgcaatgactcacaaaaggtgacctcacactttgatgatagaaatatgtcatacagttaggttcttttttccagtccagtttttttagcatgctttttctataaaataaattttattatatatatttaaggtatgcaacatgttatgcatatagatagtaacatgattactatagtaaagcaaattatatctatcatctcacaaagttacccatttttgtgtgtgcatggaaagagcaagtaaaatctactcactcatcacaaatctcaaatataatacaatattattaactatagtcctcatgttgtacattagatctctagatttgtttatcttacttatctgatactttgtattctttgacttacatacctccatttcctccctcttcatatccccgacacattattttattctctatctttctatattgaactttttttagattccacatataaataagatcatgcaatatttttattctgtgtctggcttatttcacttagcataatgtcccccaggctcatccatgttgtggcaaatggtaagattttcttctttgatgagacttaataatattccactgtaaatatatgacacagtttctttctttattcctctatctgataagggatttatttaagagaactcatacaactcaatagcaaaaagccaaataatcagattaaataattggcaaagaacctgaatagatatttctccaacgaagacacacacaaataaatggccaatggttatatgaatgggttctcaacatcactaatcatcatgaaaatgcaaataaaaactactatgaaatatcacttcacacttgttaggatgtctattattaaaaagacaagagaaggcaagtgttggtgagagtatagagaaaagggaacacgtgcactgtaggtgggaatgtagattcatgtagccattatggaaaacaatatggaggttcctaaagaaattaactataaaactactatatgacccagcaatcccactactgggtatttatttaaagaaaatgaaatacaccactagtaaagatatctgcattcccatgttcactgcagacttattcacaatagcaaagacatggaaacaactctcatttctcttgatttccctttgtatctgataccagtgtgtactccttacacacacctggattattgtgcctgctcagtaacctactgtacacctgttctctcaggtctcctcttgatcacacccatagaaagcaaagaggtagtgacatgccagagcaggtgaacattttttactgatgcttcatttacttgtaaccaaaagttacttcttcagtgtttttctcctgttgtctactaagtggagaatctaatgtattctgttaatagattacacaaaataatttccctgagtgtgtagaaaatctaaaaggtcaaattcttagaaattttagtggaaaaaatctgtgatattataaatattcagaataccactcacacatgaatttgatggggattttaatttctggggaaatatttgttattctttcttatgacacttgtggcattttaaaagaaccaaggctatagaattggtgtaattcaacaatgttttagaaatgcttactttttggtaaggactatcaatgagtattaagtgattcactccttacattttttgtgtgtgagaagatgtttatgtgtatatataggcatatatgtatacaggtagatctaagtatggtgtatttacatatgtgtatatatacatgtatatatacacacatatattttcagtaaatgtgtgttttacatttactgaaaaggttccctgatgttcagctctgccaccttctcatgaaggggttccctatatttgtataatcttatctctgattctctagttggctccactagctattcattgctccagggcaaatattcttgtctgaactactgtagttttgtcctaggcgtttgctccttattagtgcaactcctgtaggtatttttcttcaataaaattgccttgcagaggttgcagtgttcagacatagcgccattgcactccagcctgggcgacagacatgtatctgtatctaatcatatatctttatctcatatatatatatatataatatatatatttaagagggcaaaaatatgcagcagtatttccaaatatttagtgcttgtagtttttctcttaatttttattcatgccttggaaatgttggctgtaaaatttagatgaatcttagcaatgctcgatttttacaggaccctaattatctttgtttattttatttagttgttttctactttcttttccctctttcagttattattgacaccatgatttataaaacacagtttaagcaattttaaatcctcttggattgtttctatgtttttaaagagaattaagcctgtatgttttcctaatgagtaacttgtattcggcagaaatcctcaagaaatagtcaagtaacataaagagatcacaataataattaaatataaaagcagacagcaatacaaaaatatttaacacaattgtaaatatttatatttttataaagacttgttatttgtaagcaaatcaatttgtacattcacctgtagttaggaattagttttatcgtccacataaaattgaaaatattactatgaaaccaataaagtgtctttcagtggaaatgatcaattgtcttatagtgcccctttcctagttaaatataggttaactaacacttgttggtttagacaacgaatgtttaattcctacataattttttataagaacatatgtaagtatttcagcatttgtctgtaatatcagaactgtgtcatgtttgagtcatagtgaataccaccacaatgctcttttcaagtactggaggatttctaggcttatgtaattacttccgttcatgtcctgattattgtttactgtcagaatcactccgaagaggtttatgagaaatgcggctcccatccccggtcatcccatttcctaaaaacaacccactcatcactatgaattgctgttgtgttctaaaatattatggctactattctacataaggaccattgtttacacaggccatatctgtaacctcttgaaacttttaaaattgtatttccatggaaaatatatttcaatttttttatataaaggagaaaaataaaaaaaacaaagtacatctaaaaatcaacttacatttgcaataaaaactttttaaaaattaagaataaaaggaaactttctgaatctgataatgaatgcttttaagccttgacagtaattatatttaattgtgaagagttaaaacttttcctctgcaataataaaaagaaaaaaatgtttttctgtcactattatttttttcggcattgtactgaacttcctagacaatgcaatgaggcaataccatgcagttataacgcatttatagacaggtagataaataaatattggaaaagaataaataaaactaaataattaaagttaataatattttctgctagaaactcaaaatatgcatatagttacagaaaaacattaaattcataaatttagcaagtcaacagggacacaaatgttatataaaagtgcattttttaatatatgaatatatatatgtatatactctggcatatatatattcatgaaacctattttagttaaatatataatatatatgaaaagaaataaaatattcaggaatatctaaacaaaaactgtaacctctgcaaaacaactaaagataaattaatgatataagtaaatagatgaaaatactggatttaggaattagatgactacttaaaaataaaaaaatacacagcttaaaagctagctcaatcaaaatcctagtggactgtataaatggttaacttggaaagacaattaaaaaataagtaaaatttgtatggaaaaacaaggaccaagtatggtccaggcattttttgtttgtttgtttcttttgttttgtttttgtttttttgagaggaagtctcactctgtcgcccaggttggagtgcaatggcgtggtctctgaacactgcaacttccgcaaggcaattttattgaagaagaatacctacagtagttgcactaataacgagcaaacgcctaggacaaaactacagtagttcagacaataatatttgccctggagcaatgaatagctggtagagccaactagagaatcagagataagattacacaaatttagagaaccccttcaccagaaggtggcagagctgaacatcagggaaacttttcagtaaattctgcaaggtcagcttgatatctccatttatctgtccatctatctaacaccaattttgtgatataaaatttggcacctgctttacacctttcacaaatatcagcttaaaacagactgtagatccaaatgtgaaaggtaaataataagaaaaataagaatataaatattagaacaataaaactttcagaaaaaaagaaaaatagagggggaaaagcaaaaatttcagaatcagggcaaatatatgtatataatatttatggaaaacatatatttagtcctggggaatttgatatttttctcaaagcccaaatctctttttcaatttgttaaacatattttttattactcttcccagcctggattggttgttcttactctactgaagaagggtagcatatttagggtgcattatctgataagaacatgaagcatggtacaggtcatatatacctaacctctttagtctctcttcattcatttgatgaacattttattatgatagcattaatacttgcaaagtgggtcttactccattggtggatcaaaaattaaattctacattttatactggaaataggtatttctaacaaaagacaaataatatatatgaacattaataaaatcttttttagagaagattttaacattaaatatagcaccagaagaatattcttcataagtatttacatcatttaatgagtttcttagtttaactattttatcatacagtgcctttgggttatcccttgtcctctttcagatttaactatatcttaagagaagtctatttattgctcatttgtctgacagactgtttctcacactccatggaagaagctacaagtacaaagtaaatgtttgaaaaattcactctggcttattttaatgacttaataatagtcattttgtaaaacagaaaatctgggacaaatgcttctaggacatgatgacagaaacatagaagtaaagcagaactgtcctgggtaaaactgaagatctggtcactcaatctaccttaaaacaacagtgacaatataaagtggccaccaggatagcacacaaaatgaaaataacgtagcacgagttgtgtatattgaattgccacagccttaagtcctattattccctgcaatacaccatccagtaagcagaattgggtaactaccaaatgatgggaactctgaaaagtttaaattaatgagatccttgaaatcaaattagcaaggaatgtaaacagagagtgaaaaaatgctttttgggggaccgaagggtccaaagttcagcatgcatacctgagtggggtcactgtggctggatcagaggtgccagtggtatttggaaatgcaaagaatcaaaatgacttgtagtttgtatccattctaagtgaacaaaagtgtgcttagaaaaaaaaattctcttagaatcatactttaattagagtagcttatcagttcacttattctgataataaacatacaaatataattactaatgtaatcttgggttccattattgtgtggacagttgacattgtttgcattactctggagagacttttcataattgcaaatttaaaatattaattatgtctttctagctagtttccaaatcttggcaacttttcatagcaaaaggtctttataaaaataagttcaacacaatatttgactttgcttattttatcaatcacattctttgcagaaacttattgtaacataggtcagtggtccttaacttctttggcaccagggaccagtttcgtggaagacaatttttccatggtcagggtggggagtgggcatggggatggtctggggatgattaaagcgcattacagttattgtgcactttatttctactattactacattgtaatatataataaaataactacacaactcaccataatgaggaatcagtgggagccctgagcttggtttcctgcaactagatagtcccacctggcagtgatgggagacagtgacagattattaagcattagattttcataaggaacatgcaacctagattcctcacatgtgcagttcacaatagggtttgcaatcctatgaaaatctaatcccgccactgatctgacaggaggcggagctcaggtggtaatgcaaaccatgaggagcggctgtaaatacaaatgaggcttagctcttttgcctgctgctcacctcctgctgtgcagcccggttcctaagaggccacagacaagcaccagtctgtggcctggttgttgggaacccctgacataggtgacacaggatgtacacttgtaccacgtgcttgaaaggaaaacgttagtttggtcatctctggaaattgcatttactgatatatttttcatttttatgacagaaaattttagtgtgataatagtatcttaacagaagataatatatttgttgtgtgtgtgaaatgaagcattcttgtaatgtttaaaggtgctaacctgtataaaactacatagaaattttaaagattgagagcattaatgaaagcatcaataataatttatccaaacatcagatgtattctgccatcactgagtaaaacctgaggtaaaggtagtgtaactctgtctctgttgagttatgtaaattttattattaaccaggagttatgcagaggatgaaactattctcatgcagatgtttaacatggcttacaactttattaaatgatgttctttcctgtgtcacatagaatgctttatccactggtgattatgggaagcatataaacaaaaaatcataaaaagtgaaaaattttcctatgcagactaatttagatattatgtaagcaatagagaaattagcaacctgtggcgagggcattttataattaaagcttacatttattatggaatactaaagtacaggtgccacagtatgctatagtgtttgaatgccaagattccagctgtagatttcaaaatgacatttactttagaatgttatattttattcattttgaattcaatagtaaggagattaactgttcttttcttacaatgtagatataaatttaatggaaaagctatttttacatccagttttagtacaagtatactttgattaatctgaaacaaatttattgagatgttgggttgtataattgtcaacttcaatgttatacagatcaaataatattatagtgatccacactctgcatatgtaatttctgcaacaataaaacaggattaagatgaatgaggtgatcaaatgatcaaatacatgacataagagttgtataggtatatctgctcactccttcacattgggaacttattttattagtacaaggataattatttttctaccagtactgactgacccattcttgctgcatttatacttgagctgcaattactctacaacctaaagtctcgaagtgaaactcaggaaacagataatattttctcacttgtcatcttaactgggcaaagtgttcttcaaattttttatttttctgtccatagtcacctaaaaactaggtcatttttattatttttgtgctgcatttttgacacctctactttttataatctgagataatggaatttaagtaaaacaaattagactgtgtttaataaatcaaacaatattatatttagaagaataagaagagaaattcatcccagtctcagtcatgttcaactcatgttcccaaaggcaagagatttatagaatctaattcacaaatgtgataaattttgaaaattcatgattttttattttcctgagtattaactgaaattaaatttgtatagattttccatacaaagcttaaggtgaatttaatatttctataaaagctctcctttatgacatattgtaccatattgttgatgaagaatattaaattttctatatgcttttccaaaaaatgcaacttaaaatattgcataataattacagagatcattataacatattatatttgaatttaaaatctgaaatgccaaaataagcttccttaaatagtaaggtaaacagagtcttactcactagttatccccattcattttcaaaagcatctggttttgaaaataaaaggaaatggttattgcaagtggaaggaatgttggacacttgataatattaaaaatgatgccctcagtgactacagatatgaaaaatttggtggaggatatttatttggaaaagctccaaagagagtggatagtctttttactagacaatatattctccttgcttttattaggcagaaatatgtgaaactaaattttaaggaagtcagattttaaattttccttttgcatttgcacatacacagacatataaacaaagtctattaacactaatgatcattcataatgtgtacaatatcaatatctatttattatggttgttttccacgtaatgtgactggctaaagcatgtttcacttttagcaggattttgtgctgatttgcagaagataagttacccgactctgctttggtttaattgcttattaagtagtatactacacgtattttaaatgccccttcttttttttttttttgacattataaggttttaggtaaaactagcaaatattactgaaatggaagattacatatttgataggctggctattcagatacaatttcagaatgatttccatgaatttcacatctcccgaaatcttctatttatatcctaaactattctaatcacttatttagcatttttttgtccacccatgtactcactcatttatttattcaatccttccaaatctcagtcactctatgacttgtggtctaataaatcttatatttttggatggcagaaaaatagtaactttgcaaatccaaagtgacaattgggaaagcataatgttttatctcaactctacttgaaagttctagtttgaagttaatttcatttcaaacataaatgcagtcagtaaaagcccatcattacttgtaaagaaatgtgtgtttaataagcaacaagttaataattttcttgattttatctcatgacataatgaaatatggattcccttcagtaattcaaaccaaattctgagttcaagtgcagattcaaatataataataggcagttcacttcaatacaacagaaatatatgtaagaaaaagaaacagcaaaatgtttgcaatagttgtttttgaagaataaagtagctggctaggaaatttggaagtaaggtcaatattcaaaaacttaaatggccgtggatatagaaagataatgaagaattgaagttatatttaggtaataaaacccgcagtattcattaatttaatactgagattgaggaaaaaagataaatcacatataattttattaattgatttatttacttcacagtcaacacaaatgcaggaatgcttcagaaggaaaccgttgctagaagtttggcaaagcaatagaaatattcccctatttccatattatataacacttctaatagcaactgaccatcactcagctggcctctccctctcatggaaaggttacacaaagtgctcattagttcttgcatgatttcatacaaagcctggaccctaactggcactcacacagtatgtattgattacacaaattgaaaagataatttgtacctctatctcaaattgcaatgcacaaagagatttgtgcttgctagatattgcacagaccaaaccatcttttgcaatctctctgaacatctacagtggggctgcactgataccatgataccaataattctctcatgggttcactacccaactctgtaaaatggcagtattgtacctcctcttctctaaaattttacccatgctctctcaattactgccttcgcattatgcttcactgacaaaatagaaacgtttattaactgattggttatgaacaaatatgttaacatataatctgtcccttctataagtacaatggattccatgaccctttctttttttttttttttttcaagaacagtgttttagaagttatgtccttttactttgcttcaaataatattattctctggaatcattccccatagtatataacagtgctgttcaatttcctttcttaaaaaacaattgaatagtcataaacaagcaaaaagtcctcttgaccttcatctttttctacctagcatctcacatttcattttctccctgtggcgtaacaccttttagacttggcttaaatcattattacttcctcttattcttccttttatgccatacaatagtcttcagtgtgctgtaatagcacaaattaaactgttgtacttatcaaaaaaccaggggtcttcaacttaccaaatcaaaagtcaccactctgtcttaatcttagcctcacagcagcattacacacggttgagggatttcttcttttggaacatcttttctcatatttttcccttcttcctacaacgcttgccaatcccactcattctaatttgccagccgactgctttttgcttaacagtcaagtcagcctggatgcttttctcttctccagctacgttctctgccaaagggatctcattcattgccatgcctgacatacgtgttatatgttgatgacttccatattgatgtatacagccctgagcactctgctatggattcttttttcctagaatgtggtatggatggcctctttgtataattcacctcaaatatcacctcctaaaatgtcccgtttcctccagacaattaataatcatcatacctcacccatacataacacttttatactatacatgatcatatattacctcctttaattaaaataactatttcttatttgtatataactaaaatgtgtttcatattagcaggtaactcctttatctcctttacaattttatctatagtttcaaaggaagattcctagcatgttacatcataatatatgcaagaagaagaagaagcagtggcagaggaagaaaagcaagaagcagagggaggaaggaggaagagagggaataaggagacagaggggagggcagtaagggaaaggagtagaaggtggagaagggggaggaggagagggagggatgaggaaggtgaactgtttctttgcctacctaccaaaatagagtaatttaaagtgctatttacatctcataataatttgtcttgatatatattacacaggcaaatttgtttctgctgtatttaaagacctatgttccaaacaatgtagaaatacatctttaaattcctacctggaatgttaaaaatcaagaatcagaaaattatatgatgaaatatgtatttttggaatcattggctaatgaatcaagtaatgaggtaaagtagttataagcatgttaccgtaatttaaaatggccattatcaagtcacatttatttgtcactgttaagtaaatttttgaattaaactttccagtatattgtgctacaaaaattttttgagtgaataactgagagaagttgtgcataatcacaatttcccctttactggaaagacatttctaatttccaagacagtcaattcttatatcttatggaaaccattctctcctaaatgcattatatttaaaatattaacaacaacaacactgggttttgaaaagtatctttgaataaacacagccacacacaggtgttcaaccacttagttttgtcttagtggttttttcttcatgattttgatgtatacaatagagtctaataaattcacttttcctatttttatgcatatcttgcaggattatcttatttgcttttatgagatacaaaaatatattttgttttgaaaaagaaattcttgtacttaagaacctagtaaatgaacaaggtctaaaaacttacgaattgctcaaataaacatatctaaacttcttttattcctgtgaaggctgagatattttaataacattaatatgtagtacccttttctcaaaattttgatgcatagtctaatttttcaaatattttacttaaacatatttgtagaaggaagttctagtatagacccttaaatcatctacttccaaaacatatccttcaaattttaaacctgcttcattgttaatatatctttgatgtaaattaatatgcaataccttctggagacatctctggtacaatggcctcataaggttcatctaggaattttggttcattgtcattgatatccgaaactttgatgacaaactcagactcaggttccacagcccttccagtagcgatgtctattacctgggctcttaagatgtagagggatcgctcctctctatcaagcttctgtatggcatatatgtcacctgttctttcatcaatgataaaagtacttccagctccagctcccaaaagcttgtactggaaagaattgtttccattgtctaaatcagatcttagctgcaaatggaaagagggatcatttagtttccaaacatctgaaatggacaaatcaaaatcaagattttctttttatgtatgttaattattccccaagttaatgattttatattatttccacattacattaaatgaggcaaaatattaatatcaagattaaaatctatcaccagggagaaggaagagtgaatatttagtgtaaagaactatacacatttcattattctaaacagaaacaaaaataattggataataaagcttcttttgtaagttatgcacaacatagttggttcagtttttatttataattaaattctcagtcactaaaactatactctcaaatatttatactagattgggtccttgagatagatagaaagacaatttagtgacatttaaacactgatgttctatctcttgcatgaatatacatggaaacaagaaaatattaggatgaaaattagggttcataaagataatgataatcttgactgttcattaggtatttattacatgtcataaaatctataaattgctttatattagtgttctcaagtaattctcatatcaatattatgaaatacatattattgatatgatcaatttttctatagagaagaaaagtgagattttgttttacaaacttttttcagagtcatatggtctttgtgtagatatagaatttacaccacgaggctatcaaatcttctatgaggctgtcaaatttcagactgtccactgacaacaactcagttacatcttctttagcccttgggttttagccataaagtataaaactttcttctcaatatattctacctaattctcaaatacacactttcagcctgtgcactcattttcatattttcaaaaagcaaagtaaattagttcatcattcatactgttgaggtattatttagaatttttaatttatctgtaaaaaaacccgtctaattctgatatagttaaaatgatcacatagcttttcatatcagaattatttgtatgtaagagaagaatgtcatggttccctaatcattgtgaatccacattttcttgattcaccatttatgaaaatgctcttattcacagtaagagttcctctgaaaatttacaaagataatcatgaaatcagttgtaaacaaattcatgatttttctgatggcttaagttataatttcttatactggataaattaatacactttctttgcggttgtggagaaaatctgaaggtactagtaactaattttgcattttaataacatgccgaatatcaatgctatgtaatgaaaaataacatccagattgtctttctggtaatacttcttttgatagttcttaattattcctaaaagaaattcttcatgcgatgatgtaagaaattgaggaacaaattatacaatcaaatcaatatatcaagtgagcaatgtatggttcatatttttaaattatatcatttcaatatgatttgataatttatttgatattataatgaagataaattaagtttagtaataagtaaatatattgcaagtatatgtgcagtgtaattttcaaagacaagtaagcttgacatttttaagacccagatttaagggaagacagaaacaaaaacgaaaaagcttacttgaacaccagccttttaatgtcataaaatgcatatgttaaacacatttcaatcaaatggcctgtagtattatacaattttctatatttttattcaaaaaatattttcctaattaggctgctactatcaatttgctaaacaaatatcacttcaaattttcacttaattgtacttcccaatcttaatcatttttcaaacaaatggatcaaagagagttatcttgaacgcagcagctaaattgtatatttactaactcttttgacaagcacctaaacattcattattgttctttttgaaatcagtgattcacttgttttttaagcctgatgagtttgtgtagcagaaaaacatttttcagagtagtttcataaatatgtctctgaaatgaaaaaataggcaaaaccaatcactgtgagaaaggaggtaaacagagattcatgtggggagtagaaacaaacaaactagaaaatgtgacagccccagaggtggcctgtgttccaattacactgatgcacttccctataacaccttatttactaaaagccaatagctgattttagcctgtcaccccattcagtgatgggagagtatatggtgttctgtgcagtccactgtaaaggtagctagagactcagttactgagtcggcacctaactgtggaccttcttagtgccaactgtgcgtattatttacctgtagtctgagtcgaaaataaaaggggttgagaaatatttcttgtaatgtgtgtgtgtgtgtatgcgtgtgtgtgtgtgttcacaatacaccctcctccctgcacgtttggaaatacttgcctaaaatcctaatctaaggctttggttgaatgtactcatatacatttggctgataacacaggtgaagttctatggaatccagataccatgctaacactgcagctctcctgaaagggctagaaaatgagagttaataaattttgagtgcttcaccctttgggcccaattaaattttagtgccagttaattagcggttaaacttatttcagttcatttatctagagaaaaagccttatggaaaaggacatgatattgtaatcacctttgtttaaagaaaaccaaataataaaatacaagccaaaaacataaataggagatgctttgtctcattaaggaattgttcttaaaatatattcttttaagaaagtgaacataattattccttttactttaactttactaatcaatttaagtgtgtaggctcctgaagctacttaactgtaggagaatatggtattaacctgcttcattaaaaatgaacgaggggtaaatcaacagctacttagcgtaacagaaaatcgggctaaatactgttggtaaatgatatttgtctcactgtgactgcttagattcattaccaaaaataacgcaataaagtttccagatgttgaaaatgagggctgcattttcatacgggatactgaagtgaaatttaaaaaccagagctatccctcttcaagattttagtggatgttttaggtgcttgcaaatctgaaacaattattgatgctgctgtttgaagcttttcaatggcttcactgtaaaaatgtggaactcatcaaatctccaaacttctccaacatatttatttacattgttgtgctatttactgtaacattttaaataaataagtacctggccgatgtgatgactagtcgtattcatttcctctggtacaaaaaattggttccacacccagccacgcttcactctcaaatgagatcgcactggctgcttgactttctttgtttgagagttttctgttgctccaagacaaggccataggagaggaattcccaacataaaacgcagcagtaaataacagttcattgcgttgactcttttgattccaactattactcttcagaggaaacaggacgtcactaacaaaaatcttgctttcttttataatcttttctgattctgtgtaccttctatatacctaaagcgtcagaaacaaaacaaaatttgacattttaaaataacattttctcacataattactaaagacaggttacaacttctgcatctgacaaaagtggaataaaaataaacatttaatttatcttccaattaagctggctaattatgatttgtagctcagcaataatttgattagaataattataaatttccactcaggcactgctagttttaaactgcagtcataaatctgcctgaaagttgaaagattgctctgggagtctcctggattgacagctgacattgagatagacttccttttaatttgacttgcttactttctccattctttctcagtaaaatacaaactatctcattaaagcaacagtcaatccaggaggaaaaaagtcttatttttcctttttatatttgatagagataagcttcctcatccaatttcccaaattatggtattttatgtagtaattaaatagacaaaatgacaattcagcttaaaactggtgaattcaataatcagttacactgatactataaaacactgaatagaaagcttgcataagatatttactcttttttaatttcaaagatatggggaagaagtgtttatcagcttaacaaaaacaaaatcctcttaggacaataaatacaaaatgattgttcctgggtaagaatgggtgaatgtttgtaatatgtaagaatgatatgaaatgtatcttctagtatttaaatattaaaacaaaagactctggctattgagttttacatttaaaactttccattgacccaaggctctctcttcatgatgggtacctctaatccttatatgtaacttaatagttttgcatttccaacatctacatccagccaaatttgatttattttatgaagaaaaataattttgtaagattcacaatggagtttaatgtcatataatcaacagaaaagccagagttcatgttaggactttttctacatgattgtgttttgaatcttctgcatgtatttttgaatgactccttagagattttttaggtctttggctcgtgttaagaggagttgttaaaaaacacctaattaagaaagtacacagggattctgtggtcccggtatactccctttaagcagatgtattccttgttaaaagtttacttaatgaaggtcatagagaaattcaactgaggtgaaatttatctttatgttacgtatttgaaattcagataaatctgctctttagaaattgctaaaatatatatttttggtagctgatgaataaaaatatttggaactggtacaatattattcatgaaaaagattttttttataagtttggcaaattattaccaacactgatatgaagttagctggctgtgtttcagtgaatataatttttgggaactttatattatggtattttgatacatataaagataaataaaatagtgtaatgaacacctggatatcattaccctgtttcagtaattaccaacacatggtcaatattgtgtcatttctacacgtgctcactttttaatattaaaaccaatttcaaattcatatcattttaaccactgaagccacacacacacacacacacacacacacacaagtatacatgttatgtaagtgtgtatacacacttttaaacatcaaagcttaaaattaagaaaaaattttaatataataaaatattcatacagtgttcaaattaaaaatctttatctttgaattaagatttaaatatgtccacacaatgcagttttttggtacatttctcaattctcatttggtctacaggtttcctccaatttttctttccgtttatatgctgaagagtcaaggttatttgtcctacagagtttcacatagtctgaatgttgctaattgtatcactgttgtgtgattcagtatgtttctttatcctccatattttttataaatgtttaggggcttgattagaagtaatataaaatattcatcaaaaatattcatagccaatcctattgcatgacatctttagtagactaggacacaaaatatatgttcaagagaccagaagaaatgttgaacgtgttaagcagaaaaattgaaaaaataaaataaagattaaacttttagagaataatactacaatgtctgtgatgaaatacactgcatatgattaatggcatattattcacactgagaaaaaaaaacagttaaactgaagacaaatataaatcttctgaaaaaacataatgagaaacaagttaaaaaattaaaaatgaacaaactatcattgagttgtgagacaatttcaaacattctcatttatgtataactgcagtttctagaaccaatgaaatttagaaactcatacatccaaaatgtttaacaaaacttaagcacaggtgttaaaaaatattataccaaggagcatcatgattaaattactcaaaaccattaataatgagaaaatctgaaaggtagacaacgatatgttatatatagaataacaaagataaagttgttagcagatgtctcatctcaaacaatgcatgccaaatgacactgcagaaacatttttaaagtattgaaaatgaaaagaaattaatccaactgagaatttctcaaccaatcacaatgatttttgtaaagagatcagctgaattgaaagagaagaaactgagctgtcaggtattggaacagctaatccaaagaacatgtaaaaaaattaagaggtaagcctttagacacttagtgcaatagtataagcaagaggctaaaacaaaagaaattgttgcatctccttttttcatttcctccatggaacagcactctaattcagaggataagcacagacctgtggatcatttcattataatggtagtgctacaaaaaactaagtcattttttatggactctggggtcgggggagtgcaaggggagtgttaagagtgaaaaagtactaagtacattgtcagagtgggaaactgtcttcaaggtttcacccactttactcaataaggagacctcatcagaaatgctggagaaagacctctgcccaaggccacagataaagccctctttacactttaacactggggctagtaatgcaaatatgagaagagcatgacctaacagaagggactgtgtccttgactgcaactcccttcagagaatgcaatgcactggttgtgcatcaaatctggtgtgacaagggaatgttttcgcagtgactactgtactgccaggtcaagtctttatagctgcctatcaccaggcctgaacaaatcacagttgttacaccaaagccgtattcctaatcttcaataaaggaaagtgggatgaagactctttctggtgtacagcatcagcacacaaggggaactacaatacgatacatgattaaatgagtccttcaagaagaaataaaataatactagaaggaaatctggatctatgcaaaaatagaatcaccagaaatggaaggtatatcagtaaatagaaagaccttctttaaattataatatcattaaaggagaattggctgttaaagcaaaaataataacaaagtattgtggagcatacatcatttacagaagtaaaatgtatgaaattaacagcataaagattaggaatatgctattttaagctccataaaccatatataaagtggtatgatataacttaaaatagattataataatggtacatgcgcatataataaacctaaagcaactactaaaataaaataacagagtttactacaggctacaaaatagataaaactgaagcctaaagaatactcaatctaaagaaaaaataaaagaaaaaagtgagcaaaggacaggtgaaaaaaacatacaagtagcaaagcagtatgtttaatattaaccataataataatcactctaaatattaatgggataaaaaaatcaaagtatgagatgaggattattagatttttaaaaagactcaactatatgtctttaaaatgatttaaaatataaaggtacagtaggtaagaatttaaagaatgaaaaacatatatcttgctcaactctagtcaaaagaaagctacaatggccataatattagataatgtagattttgggacaaagaatattagcagtgataaataatatcatttcataattataaatttcataattataagtgataaacatatcatttcataattataaatgataaacaatgtcatttcataatataaaacaatatcatttcataagaattatgtcaattcattaacagggcacaacttttctaaatgtttatacacttaataacaatgcctcaaaataaatgaaatacaagatgaaataaaaccttattgtattacaagaagaaacacacaaatctataattcaaattgattcatttctattcaacattatactgaaaattctatccaatgaaataagaaatgagaagcatctagattaaaaagataaaaatatgtttatttacacagggcataaatacacatatagaaaatcttatgaaatctataaaaatactggtaaaatctataggtaactttagcagggttggaggatacacggtcaatattaaaatcaattatatttctatttactagcaacgcataagcaaaatttaaaatttatacaacagtacattttataataatataaataattcaaagattgggacataaatctaacaaaaatgtgcaatacctctctattgcacactataaaatactgctaagaggaatcaagaaaaatcaatatgattggagatatttatgatgatactggatcagaaaactcaaaatggttaaaaatgtcaattccctccaaagtgttgtataaatgcaattttaaaaatacaattaaattaaaattaaaatacaaaataaaattccaaacaggtatttttataaaacttacatgctcattctataattatatatgcaaaagcatggggcttagaataactcaaagaacattttaaaagaagaggaaatttggaagactatgccatctgactttaacacataatgctacagtaatcattatggtaaagtattggatcaacaaataatttagtagaacaaaccacaaagtgtacaaatacacctacatttatgtgatcaattgatttttgaaaaagttcaaaaggtgaatcaatggagaaataacagtctttgtgctaaaacacctgagtattcacttgagaaaaagatactttcatccatactttaccgtgcatgaggtcacaaaaagtgaatacaaatttagatgaaatacttgtaatttctttggcaaagatttcttacaacaatatcaaagtgcacttgttaaaaactgttaaattggaccatatcaaaatggagataatctctgtatcagatcccattgctactgtaaagaattcccacaactcagtgtcttaaaatgatacacatttattgtcttacagttctataggtgagatgtttaaaatgaatttcactggactgaaaccagggtgccagaaaggtcatgcttccacccaagtctctagaggagagtctatttccttacattttccagcttctcaaagtgtattctattccttgcatgccttggttcatattccacctctaggccagcagcagagcatcttcaaatttctctctactctatcttcacattggcttctctttgttgtgttaaatttacctcttctccctttataacgacacttataatttcctttaaagtccacttggataatacaggataatcttcctacctaaagaccattaactgaatctcatgtttatctacagagatcacagtctttggttttaggtgtgaagaccttgatatctctgcgagccattatgtggtctacctcagatgataattacatgaggaaacaagtcacagactgagcgaatatttgttaattatatatcttgtattcagagtgtacaaggactttcaaaacttggaaacagagattcatcacaatttttttaaatacgcaaaatatttaaagagacatatcacaaagagttgacatgtaaaataagttaaaaaatgataatcaacaccttcagtttcaacgggtaaatgcaaattaaaactacaatgagataccagtaaactcttactagaacgaatataattaaaagactgaccttatcaagtactgaagagaacatagagcaactgtacctctcatacactgctagtgtgaatgtaaaatcgcatgactatttagaaaacagttctgcaatttgttaaaaagttaaacatatacctaccatatgatccagccattctagatattagctagatatcaaggatatctatctagatatctacctaagacaaaataaaattatatttccatatgaagatgcttacatgaatatcagagcaggtttatttgtaacagaaagaaactgggaaaagtcaaatgtctatcaacaagtcaatgtactaagaaagtgtaatatgtctatgcaatgtaatgatactcagtagtgaaaagaaatgaactactgatacagtaatatccaaaataataatgagtaaaacaagcctgccaacaaattcaggttgtgtgtttccttttgcatctaattttagaaaatttaaaacaatcatagtgactgaaatcagactaagaactgtgggaaaatgggggtgggaggaagatcaggagggaaggatgatgaagggacatgaggagacttttgagggcagtgatgattgtgctcattatctgtattgtgatgaaagtcttagaagtagaaatatgtcaaaaattcaattcaacttgagtatatgcagattattgtgccaattatacttcattaatgttgttaaaaatcttgacttgtcaaaacctagaaaaacaaattagacaactaaccgtggaacaacagataatagatgtttctgatgtgttatgatatgacctttataaagaacattgcctataaagtattttaccaaaaaaagttgaaagctaattttcaagttatgggaaattaacctgtaataaaagaacaaattaaacaggaaacaaagtaaacaaagtaaaaggaaacaatcaaacaaacccaaattgtgtctttctacagatttgctacccacagtgtaatctgtggaatagcagcatcttactacagatgcgaaatcttgagcttcttcacagataccgactttgagtctgcattttatcacactcaccacaaggtctgaatatacaataaattttaaaaaagcattgatctaccacaaaattgatctagtttatttgacatgtcaaaaaaagcaggagtataggaaagatattgctctagattaagaaagatttaagatatactagaactagtgtaaaatgtgggcattgtttgggtcatgactttacaaaactgtttttatatttgcatttttatggatttataaaaaatttagtctgtataaggtataatacatactaatgtagagatgagcaatagatgataatgagaaagtattgccagtttttttggtcattgaatgtttctttcttgttatataaaaacacgccctatttttagtcgtgtatacttgaagcatattggtattagaaatgacagggtgtcttgagaaaaagtatattttctttaaaatatctcaaaaaaatggaagataggcaaaaccattgtggtaaattgataataattgttgagttcgggtcacgagtatttggatagttgttcttttattattcacttatgcttaaaatatacgtattaaatcaacaacaaaaatatacagcaattcgtacttttaaatcaatatgttaaacaaatacaagtaattactgtaataccagctattgatgacaatgtatagaaagcagaactatacaacactcataaaatggaaaatttggacactattttggagaataatttggccaaaagcaataaattttacaatgtgtatataaagtagcagttgtattttactattttatacctagagaaatattcaaatttttccactgggaagcaagtataaattggattaattgaaaaaagaatgtttaaattaggataccatatgataataattatataagtgtttcacaattacaaggcaatgtcccataatactcttggcataaagcaattagttaagttagtaagtctaggcagagaaaactgacaaaatttgtcatggtaattacaatgattgaaataagtgaaatttgtctaaaagttgaaacttagaagtttctgcaagattctccttcctcgaaaacagtttaaagtaaatatgacaaacaacaacactcatgacatctgggtcatttttctaccaagtgctatttttccctattaaatatatgattgaaatatttctcaattcaatttaaagttaaaaatcatcatttataattctaaggaaaaagccctttaatttgaacactcttagataaaacattcaagaaaaatgaatggtagcagtaggtatatctcaataatgaaatactgtggctttgtttatactcctctatattccaaactttctataatggtcatacatttcagcagaagtgaaaaacatttcacataatgctccacttctgattgaagactggtggcagctgtcagcattgctagactgagaaacactctgggctgaaaccaggcaaataagaaaaaatgctctcgcctgaaatgggccctggataaaccagcagtggcattttgccctgcatttccaatcttgtttatattttccaatcagatgaatatgctaaaaaatctacctaacatttcagtatgaagaaatgctaatactatgtcttatgttagtgtgtttttatattttctcttattgctaatacctgggaatgttaatccatatttattttcaaagttgtaaatatatttcaaaataaaagtgcacttatattagcacaatattagatactaaactaattataatcatatttaaatagcattattataagaagaaacaacatattatggccaagtaaaattgcgagtatgtttgtgatgattaatattaggtgtcaacttgattggattgaagaatccctagatagctggttaagtattttttcttggtgtgtctgtgagggttttgccagaggagattaacattagagtcagtgaactgggagaagagtcaccctggttgtggttgggcaccatccagtcacagctgccagcatggctagaacaaagcaggtggaagaaggtgggagaaactggcttgctgagtcttctggctttcatcttcctcctgtgctggatgcttcctgtccttggatatcagactttaggttcttcggcctttggactcaaagtggtttgctgggggcctctcaggcttttggccactgaaggctgcactgttggcctccccgcttttgagactttgggactcggattgagcgactactggcttcctacctcctcagcttgcagagggcctatctgggacttcaccttgtatccgtgtgagttaattctcctaataaactccctttcatatatgcatatatcatattagcattgcacctctaaagaaccctaatacaatattttatttaatgtgttaattacatcccatatgctaggacttatattcagtaattttaagtgacctgtcctgtaaacaaatgtattcataactactgatcttaaagacatcaagtgtattctatacactgtactttattgaatggaagaaaaaaatgcataaatatctaacactgtgacatctatatctaatggttcactttgtttacattgaataaagatctataaattacattttaacgtttggaccattcttcaaatgacaaaatatatgttttctattatctcttcttagtatataatttttccccttgttctaaagattcttgaggtcaagtaaaaaaaataagtcagaatgatggatttgatggctgtgtgggggaagacataagttgaagctgggaaatgtggatgggataaatttagaaacttaatcctgtttgtgatctcttaaaaaatcaagggaaacttggcagcttcacagaatgacaccatgcataaaaagactttgaaatggctttctcagaaccactagtatgaaatataaagaaatgtgagtggatacagtttgcatacataagtgaaaaggaagcaatattttggggccaaaaattttaataacccatgtgtcaactctttctctaaacattcattgcacagcactaaaatgtgaaagatcattttctgttttatttatgaactctcattaagcatataatttgcatacttactgtcaccaaaaaaaaaaaaaaaaaaaaaaagccctctgggacagctacagcagtgtgagtcagaatagctatactggagcctctgatgccctctttgacattacacagccttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatagattccaattggttaaataaatgctggtgaaatttcatattcttagatacagtatttcactttttattcccctccacaaactatcagaccatgatttgcccttatttgtcaagggtaaatttttgtatgctcctgtattgaagatttgcctaaaacacctttatcagtatagatcttaattatgtctttaccatctttgcagtctgattttttaaaattattgtacttttttatgagcctttggtgctctcagtgttatacaaaaataaacatcagacatataagcattgataattatattctttgtttaaaaaacatagtgacaggaatagaatgaaatgaagggcatctgaaatttatagggttcgtgtgagaaaaataggaataaaaacatgattttctttttttaacttttattttgtgtttggaggtacatttgcacgtttgttatataggaaaactcatgtcacaggagtttgttgtacagattatttcattactcaggtactacgcctagtacccaatagttgttttgttctgttcttatcccacctcccaccctctgccctcaggtagggcccagtgtctgtagttcccttatttatgttaatgagttttcaccatttagctcccacttataagtgaagacatgtgatatttggttgcctgttcctgagtgagtttgctaaggataatggcctccagctacatctatgttctcacaaatcacgtagaccaaggaaacagaatacagagcctagaagtaagactgcacacctacaatcatctaatctttgacaaaaacaagcaatggggagaagactctctattccataaatggtgttgggtaactggctagccatatacaaaagattgaaactggaccctttccttacaccacatacaaaaatcaattcaaaatggattaaagacttaaacatgaaacccaaaactataaaaaccctggaagacaatctaggcaataccattctgggcatagcaacaggcaaagattttatgacaaagacaccaaaagcgatcacaacaaaaggaaaaattgacaagtggaatctaactgctcttaagaatccctgcacagcaaaataaactattaacagactaaacaggaaaactacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcacatgacaaaaagctcagtctcacttattagaggaatgaaaatcaaaagtacgagataccatcttacaccactctgaatggctattatgaaaaactcaaaaataacagatgctggtaaggttgaagggaaaaagatacacttacactgtcggtgagagtataaattagtatttacattagttcatttatgtcatcattgtggaaagcagtaaggcaatttctcaaagagctgaaaacaggactaccattcaacccagcagtcccactactgggtatatacacaaatgaatacaaataattctatcataatgacacatgcattttcactcatgcacacatgaatatacataccataaaggtacacgaatgctcattgcagcactattcacaatagcaaagacatggaaccaacctcactgctctttagtgacagactggataagaaatgtggtacacatataccatgaaatattatgcagtctgattttaacttaaccatcacatgaacacaggctatttcttattactttcctgtgtgtttgcagtcaaacctgtacaatattttcatgtttttctaaaatgtgttttttctcttaatgttcttatgacaagatatactacagaaaaataaaacactgttttacttctaatatctaaacaggtattctactattcctttgattatttcagaagataaactcacataaacctgtctttatttttagttttcatgtacaattaaaaagcactgtaaacactctcaatagccaaaatccattcactgggaggaggtacataaaattggtctcacagttgaacaaacgaccaaccgttgaatacaaacattaaaaaatttatgtcaacatgttgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttcgggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatactgtccggcacgtattaagagttaaatgtttttagtgagctacatgaaaatagctattgacaggtgaataataagcatctagtgatttctgcatttctcaaggtcgaaatattcagctattttcatttctgctaaaaatatacacacataaaaagctttgtaaatgactattgcaaaaatactttagtatatattttccctgatgtatatgttccacatgtattttcaaattatttgaatgtcattattttttttctaagcatggttaagtgactatgacagatacatattatcatgcttgaagcaatacatgatattgcatggacatatataagctgaaaatgagcccagtgtgactcagaacaattatattttcaaagaagactaattacgacttaagggatgaaaaatattataatctatgcacttatgcagtttgaaactgaatctaattagaaattgtcttttctatgacctcttcttggttacataaagctaattattccatctgtgaaaacttgtaaaaatataatgtattccggaaagctcatggaaagctgaaatattgagctcaactaagcccagcttctcatagagaaaaacagatggcaattaatataatgtctccatttttagaaaaatattgagtaggcgtggccaaaatgatatatcatagacttagaatttgtggtgatcagagagttccaaacctttcccaaaacaaagaaaaacagaaaaacttaaaggttttgaaaatgctactaaaaaataagaataagagtttctcttcatcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatggagagttagtggcagattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacattttaattttattagttagttacaatatgattttagtcttaaaagaaattatttggatcttctaatcagtgcttagaagcacctgcattaccaggacattgaaataattgttctgtttctccatcaaacaccctagatccatgaccttctattgccttcttgaaggtgatatttcatcccagcactctgactaatcctgctcttcagcaaaggacaatataagtaagagaatcaataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaaattctgaatgactaatcggatgaaatggctatgactggtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgagtgactgtgaaacttggatacacttcccccactaacttccacctgatgtttgtggtaggaggttgctgagaaatggaaggttaattggttactgtaatagcctagctccccgactaacaaaatcaactgtgtctctaatgccataatggtactcatctgttctcttagtaatttgtctcataattcaatggtacagtaaatattatattcatttcaaaagagaagaaagatcaaggtgagcttgtacaacaactcctcaaaaaatgtcattttgttgaatttcatttcagtgtaatattgatgagaaaaaagttgattcactgccagagccactatctgtgttgagtctgcacattccccccatgtctgcatgggattatctggatcctccagtcacttcccacttcccaaagctgtgcacatcacgctggttgttcatctacaaggccccagtctgagtgagtgtgaccatgtgagggtgatcctgcaatgggatggcaccctgtctagggttggttcccaccaatctccctgggtttctgggataggctcctgtcacccatggccctgaactggaataaccaggttggaaaataaacgaatacaaattattgtaaaatgaagatttgtaaagtacatgatcatcatacaaatgcaggacaataaactatgctgggtaggaaagagttcagcgagccagctgttatttgttaattcttgtgtttgaacttcatagtggccagaggtgatcctgacaatctttgttttgccaacattcatttcttgatttaacccatcaccacaactgccagtcactcactgattcgcccaaaattgggtaaataatgatcttactcatttttactaatcatatatatctatatctatatctatatatatatagatacagctcagatttatttcagtgtttaatattagaaatgttttggtccttatttataagtttagtgaagtttttgttaccagaaatatgtcatagggactaaactctcctttatctcaattagcctctgataaaattggttttattacacagtgtttcacttaaagttacagtttgaagactgaagtggaatatatgcagatacaccactaaactactgattagggaatcatacatcccaggcttcttttgatgattaatgaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatacatatttgaatatatatacatatatatatatacacacatatatatatatatctgtaaaggcaacatgaaggattacatatttttcttcgaaccaacagtgtatttcattttcccaagaatttctaacagtatttatttctttgttcttatgctttcattaagaagatatagtttcactttgcacttgttgaaactctttttagccactgcttagtatagtaaataaaccattgtattcaatttgacagtttttgctgatgttgtgatagtagctacataatacctagacaaacatatcatccaaatgttcctttctccaattatcagttgtcctttcagcacatctctctataactgtaatatctataaatttactctactatcaaaaataatacttagtaagcaccactgccaaatggtatagaaagtactattttgttatggaaaagatataatataaacatgattttataaaacacaatccttcgtgaatggaaaaagaaaactaaagtcatgcactttgttaatttgcctttctttatgtatatatatgtttgtgttgtgtagaatcagtacaaaatctaaaaattaatataattatatcacagaaccacataaatctgattcacatgaactgagtgaaatataaaaatcatttgatccaggcctgcaaaagcactttatttgacaatagcagtaattatgactttaacaaatgaacaaatatgacaaaactattattattttgttagacctcattatatttagtttaaaattttattgtgaatgtggagaatacctcaatctttaaataaatatgtagacaaataagggttagtttgatccctcaatttcagggaaattgtttctacagaaacacagaatcatttcaaaagcttgacaaaacagataatcccactccacagctactgattcatgagctgggtattttttttaacaagcctcaaagatgactttacggtaaatattttcaggaaatatcatcaccatcatcatcttgtcaaccatactgagtgtttactctgtgatgattactatgcaaagataatggcattccttaattgacttgtcttacaataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaaagaaaatgcatgtagaagttggttaacacttatttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgataccatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataagataatcactggtaatcacccattgctacaagaatcatcaaaggagcagctctcaatataaatgctatttaagccatgcaggagagggctccttccaagtcagaacgattgaaaacgggaaatatttgctatgatcatttacaaatgattttaggtgtatacaccgaagattagtgtgcacagtttctattatgtaaaattttcagagttggcagtagacaacagtacaaatctatcataaatacttataaaaactaagagagtttagatagaattttaatttagcagaaggttaaaattcttaccttatattgtcactgtcacgtccgaatatagattttgaaaatcattgataatctagcaacttacaagtggaattctatttacctactttcctatttactttaatggaaaaaacattcctgaaaagtcatattggtatttgaggaaaattaaatcttggggttctattttgaagacattttttgcacattctggacataatatcttcagattatgtggcttcagtgagtatctgcctactgcatcacaaaacagtctaagcaatccatatttatctcttttctaatctccagacctacagaactactttccacgaggcatttcaaagtgcatactgaaattcttactttctattcactcttccacctaatcgttatgttccttctttcccttaatgaaatcagcatcctgttgaaagctcacacttgaataaaaggttcttctctaatgtttccttcagctaacctcccatatacatacatttgagcatgaagcctgactagagatgaactatgattaattctatgtcttaaatccctcaagtaaattcatttacctcctattacctccaagttcttaattcataataattttaaaatctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataactttatatctattaaacaatctttccccatttcctcttcttccattctttcctttctctaataatcataattcttcactctatttctgttagcttaattttattctagctttcaaataacagttagaacttgcagtgtttatctttctgtgcctgacctatttcacttaaagtaatgcagtccaggttcatccatgttgctgtgaatgatagaatttcattcttttctatggctgaatagtatttcattgtgtatatacaccacattttatttattcttttatttcttgatggacacttagttttcttccatatattggctattgtgaattgcaatacatatattgcaatacacattggaatgcagatatattttcaatatactgatgttctttcatttcaataaatacccagtagtgagattgctgaatcatatattacttctatctagttctatttttagtttttggagaaaccttcatactgttttacataatggctgtactattttaccttctcagcaacaatgaaggagttccattttctccacattcacaacagtatttttttttagactttttgataatggacattctaactggggtgaaataatatctcattgtgattttgatttgcatttccctgatgattagtgatgttgaaaatttttccatatacttattggccttagttcataaattcttgttataaattgtttataataacagcaaaataaataggaattgtatttttgaaagtaaccaataatgtttctggagtgttaaatactgaaagtcattttattttcaatctcacatctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacctcagggtatcaagaaagtagagttctacatcacattgtattaaaaaataaactagtgttaacagatgaacacaaaaatatatatattttctaatttgtcactgaaagagaccacaacataaagaataattctggttatttcttccactaatgtacaccataagtttccaattctgatcttttatatcggccttcaattaagaaaaattaataatttgctgtatagctgaagagaagttttaggagtgaatctcaggaaacagaaataatgaattgaagggtaactggaggttaagaatgaagttccacaattcaaagtagtctttcaaagaagttgctgagagagggaaaacagagagttgggatgatagcaatgagaggtttggagttaatgaggattttttagaagatagataatgtgctgaatgaaaatgggctaaatgccccactttttaaagacccaactgtgtgctgaattaaaaatatctgtttcatgtacaatgacacccacaggctcaaagtagaggaatggagaaagatctatgaagcaaacagaaaacaagaaagagcaggagctactattcttctttcagacaaaacagacaactatcaaaaacgacaaaaatcggcattacataatgataaagggttcaattcaacaagaagacttaattatactaaatatatatgcacccaacactggagaaccaagatttagaaaccaaggtattgaagacctacgaagaaacttagataaccacacaatcataattgggagactttaacaccccaatgacagtatcagacacactaatgagttagaaaactaataaagatattcagaacctaaacttgacactttaccaaatggaactaacagacaactacagagcagtccatcaaacaacggtagaatatacattcttcttatgtacgtatggcacatgctctaaaatcaaccacacacttggccataaagcaattctcaacatgttcaaaaagcccaaagtcatacgaatcacagtcttggaacacagtgcaataacaataaaaataaataacccaaatgtccaacaatgatacactggattaagaaaatgtggcacatatacaccatggaatactatgcagccataaaaaattatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatatacctaatgctagataacgagttagtgggtgcagcgcaccagcatggcacatgtatacatatgtaactaacctgcatattgtgcacatgtaccctaaaacttaaagtataataataataaataaaattaaattaaaaaaaaaagaaaatcactcaaaccatacagttacatggaaattaaacaaattgctcctgaacgaccttcaggtcaacaatgaaattaaggcagaaaggaagaagttctttgaaactaatgaaaatatagacacaacataccagaatctctggaacactgctaaagcagtgttaagaggaaagtttattagtcttaaatgtccatatcaaaaagttagaaagatctttacttaataacgtaacatcacacctagaggaaatacaaaaacaagagcaaaccaacccagagttaacataaaaaatagctagctgagctgaaagaaatggagacatgaaaaacacacataacatcaacaaaaccaaagttgttctttgaaagaataaataagattagtatagtactagaagactaataaagaaaaaaaaaaggatccaaataaacacaactggaaatgtccaaggggacattaccaccggccccacagaaaaaaaaaaaaaaaaaaaaaacctgagagactctatgcacacatagtagaaaacctagaagacattgataaattcctggaaacatacaaccacccaagactgaatcaggaagaaactgaaagagattaatagtgagttccaaaattgaatcagtaataaaaaacctacccaaaaggaaaagccttggactagacgaattcacagccaaattataccagatactataaagaagacggggtatcaattttactgaaactatttcaaaaatttgaggaggatggactcctttctaactcgttctataaggccggcatcattctaataccaaaatctgtcagagactcaatagcagaagaaaacttcaggccaatatcctggtgaacatagattcaaaagtcctcaacaaaatactaacaaaccaaatacagcaacatatcaaattcaatccatcatgataagattaccttgtttcctgggatgcaagattagtttaacatatgtaaataaataaatgtgattcataacataagcagaactagaaacaaaaatcacatgatcatgtccatacacacagaaaagcttctgataacatttaatatctcttcatattaaaaaccctgaaaaaaaggcataaaagggacatacctgaaatataataagagccatctatgacaaattcacagcaaacatgatactgaatgggcaagcgctggaaacatttcccttgagaactggaacaagacaaggatgctgactctcaccactcctatttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgagaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccatctcaaaaaaaaaaaaaaaaaaaaatcatactaatgttcacaggaaaccacaaaagagcccaaagagccaaagcaatcttaagttaaaaaaaaaaaaaaaaagctggaagaaccacactacctgacttaaaagtgtactacaaggctacagtaattaaaacagtatggtactggtacaaaaacagactcatagaccaacagaactggttagagaacctagaggctgcatatccacaaccatctgatcttcgatgaagccatccataataagcaatggggaaaggactccttttaaataagtggtgctgggataactggctaggcatattcagaagatttaaactggaccccttccttccaccatataaaaaaatcagtacagattaaatacttaaatgtaaatcctacaactataaacaccctaggagaaaacctaggaaatactattctggacataggccctggcaaagattccataacagactccaaaagtgattggaacaaaaattaaaattgacatgtgggacctaatcaaactaaagagcttctgcacagcaaaagaaagtatcaacggagcaaacagacaacacacagaatcagagaaaatatttgcaaactattcatccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaatctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatcactaccattcaactcagcaatcctagtagtggattattaactatatatttgaaggaatatatagttctaccataaagatatatgcacaaatatgttcatcacagcacttttcacaataggaaagacatggaatcaacctggatgctcatcaacaatggacataataaggaaatctgacacatttacacaatggaatactatacagccataaaaatgagatcatgtcctttgccccaataggatggaactggaggccattatctcaagcaaactaatgcaagaacagaaaatcaaatactgcatgttctcacttataagtggaaaacttaacattgagtacacatggacagcacagtaatagacactggggcctaacctacttcagggtggggtgaggagagggcgagaatcaaaaaactatctgtcaggtagtattatcactacctgggtgatgatataatttgtacactaaaccgcagcaacatgcaatttacacatgtaacaagctagcacatgtaccccctgaaactcagagttagaaagtaaaaatttaattgaagctataataaaatatagaatactaaaatggaaagtacacttcaaagacatgctataaaaggtaaataagaatatattattattttgatacaaaatattttggaattcaatctcaagataagaattattttagtttcaaattgtataatataaaattgaatgtttagcctctttcataaaggatataatgtaaaaaattgtatcacttgttttatatttattttttatattttctgcatattaacttaaattcatatttgtaaaactttattttgttgagtttattcagagtatttaatcatgaaaaggtattgtcaacataaaacgtggtgccagatggactaggttagcacaatgtttaatgctattattgcatattttggggattttttttaattgtctgctatgagctgtgtatgaagaatgactaagtaatattcagccagcacggaaagagaaatatcacattttgtcatctttatgtggaatctaaaacaatggaactcatagaggcataaagtagactggtatttacagaggctggtggggtggggcagatgaggaaatgaaggtcaaatctcagacaggaggagtatgtttcacgtttcagaaggggttctattagacagtgtggcgaatacagttaatagtagagtattctacatttcaaaattcctaagagagcaaagtttaaatgttctcaccacaaaaaatgttaaatatttgaggtgatggatatattaactagcctgatttaatcattccacattgttttcatgaattctaacatcagtttatgtctcataaatttattcaattataaattgtcaattttcaataaaaaataaatattgaaaacatcctataaacagattaataaattgttttaacattaatggcatgaatataggataaataaatttctactttttaattcccaaaatgagaaattcaagaatatcaccttaattataaacaaaaatgtgtatggtataaaacaaaacagaagtgttttgagttttttaaacacagaagacagtaaagtatacgtccaagggttgtatgtaatgggttaaaaatatgtatcaacttaaggaaggaaaacagtcatgaacgtttatgaaacagtcgtgaatatagttaattcatgttacaagctggatttaaaaataaagatagataggatatcttaagtatgtaaatcctttgaaatttgtgccagatagaataaacatactttcttttagtacttaaatgtaacagcatttagtataatctaaatgcgtgactgggattattgaataaataaatgtgactttattcctaaaattttaaattatgtggactctgaacctgcaccaaattgtcaataagtatacagacagctagaatatgctgttgaaagggatgatgttttatataaaataattccttactttattttttaaaaatctggcaaccctaaagttctaatgttttgtttcataatatttaagggtcagttaagtaatgtcttgctgagatttttaatatttaactcactctcttaaaagtctattgctttttccttttttatgcacaaaaaaatctcaatgacatgattataatctcataaaaatcatatttgtgagttaagaattgtatgttttaaacactggtttaaaaatgcaatacacacacacgtacacaaaatgacaacatcgctttgtatctttaaaaatactttaaattaaatttcatgtaagtggttttattaaatccatattgtataaaatgacatgaaagttttataaataattcacatggtcttgaaattatcaaaggagtatacacatgcattcaaaattatctgttaatagagaaatgtgtagccaggtacacatatgtgtgtgaaaacatcaatacgcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaagaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagtcaaaaaaatagcgacttcttttctgtgatgtatttatgatttgctcatttccacaggaatgacatttctaaattttgcacacagataaaactgcctaggttattttaagacatgactgatgtgccaaaattatccccactttaatacagtatcttgcaaatttgcaaatttcatttatcatgaaacttcttagaattaaaaaacagctaaactggatctactgctctggtatgttgagaaaccactgtcctaaaataacatttcaaatttcacgtgttgtgccaaggcaggatttttaaaaatgatgttttgctttaatcttaagacatacttggatgattctgaatataattattgagtaattaatgtgacacattttgacaaaggtatgtattctagagtatgttttaaattcagacaagcattctcttaacgaatcatatcagcatattcaagagggcaggcatcatttgaaaaggaaattgatctgttacacattttgacaggctttagagcatttagctgtgttctctcaattgaaaggtggtgagagtgggtaaaaaaaaacgctgtaagggtacagtttatcttgttttgttttgatttgattttaaagtggcaaacatctttctagtcacttttgcaaagacactcattttgtcaatcaggggctgtcttcaccattgatagaaaggattcctgtgggattattattacgttccatacttagttgtgtttcaacttcaatctgtttcaccaaagcaaagatacaggtgatagaagatcatcgatgttaaaggaaatcgtcgtgacaacaaatttttcttattcaccagcatggttctcaaacacttggttaggagcaataaattctcatgtaaagaaggtatatagaaagatcaatatctccttttaaacagtttaacacatttattcctaatgcattactactcactaacatgctgaatactgctatgtaatgttttaaacataacatatatttaagagtacatgctaagatcatgagtggcaaaaatgatcagttgatatttagttatagatgatatgtatcagattatatgtagctgtattaggagaaattcctgaaagatggatctggtttcttaataatgcataggaggcatctgtgcacatcattttaaagcatcttcaatttatgataatttaatcaaaaatttttttatgtttcttgaggaaatgtaccttacaaacattcctaagtgaaaaacaaaacaaaacaaaaaatataagtagaagacatatgcttttcgatatatgcagatgtgtctgtgtgtgcctaaaattataaatatttcactggagcctaagtaaagaatttactaatgtgtaagactgtaaaaatcagatatttatataatgatatgagcatttcgttcactgttataaaggcttggtaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactgctgataattacaatattaagaatttgaaaaaagaatatattaatgcatataattttacttaatattgtaactacatctaaaacataaatatatattactaaattttcaaatattttatctaaataatgtctttcttacagatatattaattcaacaaatgaattaatagagctaaaatataaattgacataatctaaagaaaacctttgccactctatttaggtattttttgttgctaaatattttatgtttttatatttaatagatttattaaatccctttggtaaacttattttgaaatattttattataattagttattcaattaaaattgcatgtaccaaattagaattgaaacaatataaaatgtcttttacagtatgcattttcctaatttatacttttcttaatttatactttcatatttgagaaattaccttttgtgttatgtataaatgttataatacatataggtaaattaatatgcctgtacaattttaggcatatatgtgtttttattcatagcaatgctaatattttaatttttttggaattataatatacttaaaatttttcatatttattctgtatatattttttctcatatacttaatgatgacaactctattgttcatattacctgatatacatggtaaatacatgataaataaaaaataaaaccctgaacaaagaaaaaagtgcaaagaaagacatgcaaagaaaggttgattcatttattctaagaaacttgagaagttttaaatatcctaacataggtgtaacttccccccaacaccaacaatctgtattacagagatggagaactgttctcacaaatacgtgttttgagaaagttcagtacaagtacacatcatggttttaaaatttttagaatattttccttatttcctatgtaaatattttccttaatatttttagaatattttcctagcaacattttgtcatgtactttttgacctattgactcattaaagatgatgcatgtagtttataatatgcctgattatcacagtcttacctttgtaacttcaacttctagaagttctgtgaaaactgaacagcaaacttcgtgttggacacataaggaagagtaggaaaaactttcttctttttgcttcacagtcttctcagcaaactctcgatgtgccccattgcccagagttacagacgcttgtgcttttagtaccacaacactgtcagtatgtcactgcttactcaatgctattttgggttctctgagtagagtcataaacactgagccttttgtgcaaaatatcataagggcactctgacgctcgttcatagtctggaattaaaatgcagacagctacgcaagtagtatgagctgattatctttgttttttttttttttcccctaacaacaagcaaaaacaaaataaagtacttattggcctgagttgataaagggagaattcaacttacatacaagaattttgcaagtagagcggacgtgccctctgtttggggattagctgatgaaacaaatgatcaatttaaagcagacccaaaacttactgaaaagagaaatgattttccactgtgtgtctatgcctcatggctgtttcttaattcggtcatttctcctcagaaatcaagtaaagacataatgagagagaaatgtctaaactttaataagtccttttcttttccttggtttattattatgtaaaatcttttattttattcatggttataattagattttgatataagctattattatttaacataaaatacatatgtattttctatgctgtttactcaagctgttatttacttaaaaaccatttttgaaccaaactagagaaacattaaaatattaaaagtttcttaaattatacctatataataagaaagtctatgtggggcaggattattcaagcatcctgttaattctgatagatattttggtcactatcctcttagcttttgaggaaagaaatggcaaaagctatatgggcagtaaagtaggacactcaagcacacacatatacacacatgcacatgtgcacacatgcatacacatacatgtgcacacacatacatatgcacacacacgcacaaatgcacatcctatgaggttgtgaatattaggaggaatcaataatttatgaacaaatcttgaagagatgaacctgggagaatagatctgtggatagcaggaacagtataatgtggaaatattttattttttcaggtagaaaaaagcattcagctagaaaaaaacacttctaagtgtttcaagatgttagtaaatagggaaaaaataaattttacaaagaacctctgaagtattcttatacatttcccccttcatattttttacagtatcaaaaaaggtggagatacctgtttaaaatatttatttacataattcactgttctgtctatgacctagtctaggatttctgtaagaatctaacattttatgagatgccaatttatatcttgatgtttataaaatatccagttgcacttaggattgaaaccacagtttagagcctcagtgtacctgtaaacatgatgtcccaaaggcttattttagagcctaagggagcaaaggtgggtcacaatttgctgccctgattattacagtaccaataaagagcaatggcaactatagaaaccacagtgagacaggattaaattttctaaagaaggtacagtgtgaaactacatgttttatgtagaatatcattaacagcaaactgattttattaaatagataatctattatcaaacacgtacaggaactagttgctgtaaattgcttaagaaatgcatgccctttctggaagaggatataagatgaacagccgatagccaaggatccagcaagattcatccgctatgccacaaccaagaatgaagacttggaagtacttaggggactggtcatcagataagcttagtgattacttctttttttttttttttttttttgagatggaatctctctctgtcgcccaggctggagtgcagtggcgcaatctcggctcactgcaagctccacctcccgggttcacgccattctcctgcctcagcctcccgagtagctgggactacaggcgcccgccaccacgccctgctaatttttttgtatttttagtagagacggggtttcaccatgttagccaggatggtctcgatctcctgactcgtgatccgcccgccttggcctcccaaagtgctgggattacaggcttgagccaccgtacccggcccagcttaatgattacttctacgtcattttctttataacaagagaaatatatctgactaatttttcatatatgggggggtaatacatagtaaatggaacatgactgtgtaagaacagaagctcaaaattaaatacactactatccatatgtaagtcagagttatcatactcagagttatctgaggtccccacagcagtaaacatgtggcaggatggacaattcccgaaacacaagtgatgttttatagctgcacagtgacattctggtctattttcacatgcagtctgggggaatttcacagttatcacctgccagcaggctaaggaacagagcttgaagttgcagaagccaggattgtattgagttactctaaataaaaatttgaattcaagtattataattcagagccaccaattttttaaaccagataattaagaaatatatatctaatgactaaccgcagacaagactggctaatgaagtttgaatttaactgaacaggcagaaatggaaagtcaaacattatgcaagctctgatctgtcccttgaaaatagacatttaaccagaaagtttaagtctacctactttatatcataggctatacatgtgccttcaattagaaatttaggccttgtccaatcaggtgttgtcaggatagcataatctaaggaccacatccttctcacatggtctggaagcattttagttcttaaaaatatatttaagttgttttgggaaaagcttataatatgttaatacaagaacatttaaaacagatatttactgtatgctatcactatatcaatgagaaatctattgactagcaagcagatagcaaaatcaaacaaaatcaaatccaaaaatgaatagaataatgaagaaattcaatgtatacatagagaaataaagtagggttaagggttagttgatccagtggcttcctactgcaatcagttatctaggttcttgggctctgtttggttctccaacttttcctcaaggccctcaaaaacactgtcactttcgtcttattcatcaaaatgatcacttgtccatgcatgaacaaagaatggcaacaagaaaagcttaaagtaattgtcattcctgaacctgagagaaagagttagttgatagaaaaacagattcatttccccaaattagagtggagtggttgaatctagttgataaccaactagacgtccagtgttcacttcagatattcatgtaaaatagcttttaaaatgctgaaaataaaaataataattttctccatggattgccattaaatggcattcttttccaacagtccaatttgctgtgttttccattctgtttttaacattgaatatatatcacaatgataaatatggggaaataaaaaaatgcacaatgatagaacaaacaataaacaaaatattcactaatctatatacttctaaccatgctaaaatactttgtatcaaaattacacaaattttgctcagagtaaagaaatattgtcttgaatatggcaacaatttgtatggtttgaagatttatcttttaaattctagttacagtagccacttgtctaatataataaaaaattttattgtcatatatatgtccttattttcttatttttgtattcattcttttttctttttctttttatatttaattaattaattaattcatttatttatttgtttgtttgttttttgagacggagtcttgctcggtcaccctggctggagtgcagtggggcgatctcggctcactgcaagctccgcctcttgggttcaagccattctcctgcctcagcctccctaatagctgggagtacaggcacctgccaccatgcccggctaattttttgtatttttagtagaggcggggtttcaccgtgttagccaggatggtctcgatctcctgacctcgtgatctgcccgcctcggcctcccaaagttgttttgtttttattttcttttgtaagaagacttttctctggagcagtatatttaagaaatatatatatgtatgtatatttgccaagccgcaacataatctccatgacggaagaaatccattatagtaattaacaatgaataaatgtataaataacaaaaaaggctcattacaagaataatttagtaattgtcaatatgcaaacaaacaacccaaaatacttaaattcagacataaacgtgtagaggtatgtcagccttgttttctgtttatattaccagaatttattagaaacatctcacctaggcaccaacctctttgaaacggtagattaacttttactttttctttcaccaggacaatattaatatgaacatttaatttctggaagagtttccatgtttttataaaattttggttacttcttaaatttatagatcatgcacatcagcattataaacattctctctggcatcatttagaattgtaatattataaaagatgtgaagttatctgtcatctatcatctctctaatctatctatgtatctatctatagtctatcatcacctattatgtttatgcaatgtattgttctacaagtcataatgatacaaagacaagactctgaccaaccacttatttgactacacatggttgaccagcgtcttgtgtttctatcattataatccctagcccaatgtattacataaagtaaatttttatttaattaaatttttattgagacgagaaatcacagggttattgtaataatgtaagggagttactttgcattgttcttgacagataacaactcctgtatttttattactactaaataataactgctattgttactatgcttaatggtaataataaagacagtagtagttggtagaaagatgaaaatcatatttccaataaaatagtaatttaaatcaaaacaatagatttaaataatatattaaaataatatatttaaattaaaataatagatttaaatcaaaagtagagaataatgcaatattaatatattaaataagcatagtgttttaaactatttttactccacattattgtaaaactgtatgtatatgtgcatgtatatatatatatatatatatatgcatatattacacaccatgctcccacatatatatgtgtatatatacatatatatatctcaccaatcttattgagcttttcttctagttttagagtttcaggtctacgtttaagtctctaattaattttgagttgattttgtatagtgtcttaatttttctgcatgtggatatttagttttctcatcatcattcattgaaaagactatcttacccattatgtgtttttgaaatctttgttgaaattcaattaactgtaaatgtgtggactaatttccgggctctctattatgctccatcagtctatgagtctgtgtttatgctaataccatgctgttttgattactgtagctttatagtagactttgagatcaggtaggatgatgcctccagtttttctcttttttctcaagattgatttaattattcggggtcttttttggttccttccaaatttgggggttctttcaatttatctgaaaaacatatttgaaattctaatacagaatgcattgaatctgtaaattactttgggtaatatgaatattttaacaatattaactcttctcatctatgaacatggtgttggtcaacagacatatgaaaaaaaaaatgctcaatattaccaatcatctggaagatgcaagttaaaagctcagtgaaatattacctcagacttagattgggttagtttagattgaccatgaaaaaatacaaaagataacaagtgttggtgaggatgtggagaaagggaactttgcacacttttggtgtgaatgtaaattaattcagtcattatagattgcattatggaagttcctcaaataactaaaaatagaaataccatatattcagcaaacctagtactgtgtaaatagccaaataaacaacaaatcagtatgtggaggagacagcttcactcccatgctcattgcaaaattattcacagtaattaagatatagaaaaaaacctaagtgtccatcaatggatgaaaggataaagaacatgtgctatatatacataatgggataatatttaaaacaaacaaaatcctgtcaacatggacaacatgtttgcaacaacatgaatgagcctggggtatactatgttaagtgaaatatgccatgcacagaataaaaaataccctaaaatatcattatatcacaggatataatgaggaatctaaaaatatggaatctaaaaacatcaaactcagaggcagcatagaatgatggctatcagaggtttgaggtggggcaatttgggagatgttggtcaatttttttttttaaattcagttacaaaggtggactatccccaagatatatattacatgttatggtgactatagttaaaaataatatattgtatatattattacaatttttacattctcaccacaaaaaaataataggtatgtgaagtaagcatgttgattagcttgacttagtcatctcacaatgcttacatatatcaaaacatgctgtatgccatagttatacaatttttgacaaaaatgaatgaataaattggttaatataatactcatacctaataaaaatagctaatatacgcttccccccagagaaaagttcaatatatttttacatattacttggtttctccttttgttacatttcaccattttactaatacaaaagatagttcacatctgtaccatttcggcaaattttatagcaccatgaaattgtcttaaaggcagattgaactctgctaaaactcagtgttgagaaatttaatttgaacgaaccactctaccctattagccccatcctagggacatttatcatgtccaggttgtatacctaaatttagtttggtgataactttgggatctagagcttgataagcaaatttgagattatgtatttgtaaccaacttcattgaggtagctgaagttcccaagcatttcatcatttgtttttgttatctaaagcaagacacataagaaaaatctgttattattaattgaaaagagataagaggagtaactaaactgtcaaatatcactgcattaatgcaataacaatagagaagagggagcaacacaaagaataaggaggccggaaacagatttatgcatgtatgagatatgagacatgacaaaattggtgtttcaaataactagggaatggttagtaataggaagaaacattttctatacacacaatttcttacaccagattttttcacagcaacaactaatttttttccaactgaggataccaaatgagggtccaaaaattccatttaattctgacactgtctacatggagttagcttcagactcacaagtaaagggctcagtcccacacgactgtccccacttaaaactgtaaatcaccagtcctgggcgtcacatacatatgaccagcttagctgcaaatcacagattaccacaacccactcttcatgttcaataatttgctatcatggctcaaacaactcagggaaacactttatttactattactggtttattaatgaatacagatgaacagccagaggaacaggtacatataatgaactatggaagggtcttgagcacagaaatttctgttcccttggagttttagggtacccccatcccagcacatggatgcaatcacctggaagctctctgaaccccatcatttacaggggttttatgaagtttccactatgtaagcttgattgataaaatcactgaccattggtaattggactcaatcttcagccctccttcatgcatcctagaagatcttttgtaaggaagtcaggactgagaccaaatagtataacaaaagaagttttcgtctttattagtcagggaattacaagtgcttaagaaactctgtgtcagaaaactggagggaagatcaaatttcttattataccatagtttggtcatttaataaatgatgtttgaaaaaattatggtagaactctatatggagaaaaatgcatttaaatttctgctttatataatagcagagaaaattcaggcagataacattaaatgaaaataaataaaagtgtgaagaaaatatgagtccgcatttttaaaatactggatatgagatatgatatctaggactggcacagatgacaggtactgtaaagataagcaatgttttttatttgtcctaatgctatccctgcatgcggggcttaaaacctggatgacaagttgatgggtgcagcaaaccaccacggaacatgtatacttatgaaacaaacctgcaatgtcctgtacatgtatcccagaacttaaaggaaaataataaaaataagacaagcaatgttacattttttactatatagaaatttaaaatggcaaaataaatagaaaccattaatttaaaagccatgtctgaaaaaaaaaaaaaacataatacacagaccagccgaaattacatctgtcatctataatta

SEQ ID NO: 1244 - DNA, 5436 bp, Homo sapiens
tctcaaccttaacctcagtgcaggaaacaaatttctattaaataccatttattgttctcaatattatcacaaaattttatcctccatacctggattaacctgcttggctcctaaacgactgtgttttagaggaagccaccttgacttttaattcagtgcttctcaaaaggcaccgagcccgtggatccctggggcctctgtggacacgaaggcaatgattcagctgccccgggctggggcctgcacatctgcaccattgggcagagcccagggacactgaagatgggcctaggacctgggtttccctgtccaaccacctgtggctacttccactgcattgtatttacttatttatttatttatttatttttggagacagagtctcactttgtcacttaggctggaatgcagtggcaagatctcggctcactgcaacctccacctccctgtttcaagtgactctcctgcctcagcctcccgagtagctgggattacaggcgtgcaccaccacactccactgccacactcggctaagtttttgcatttttagtagagacaaggtttcaccatgttggccaggctggtcttgaactcctgacctcaagtgatccgcccacctcagcctcccaaagtgctgcgattacagaagtgaatcaccgcgcccggccacattgtaattatttaaaattaaagaaaaggtaccatccagttcctcagtcccaccatccgcagttccagtgctccacagccactgtggccagtggccccacactggacagctggatgggggcgtatccagcatcgcagaaagtgctccttgggtggcgctcggtttggtgacgggtgactgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagttcctctctggccacgcggcccctggggcactgagccttcctgtgggcacctgcctgggcagcttcacatgcaaatccctttctaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacaccccagaagcaaacagtattgacatgagcactaaaccaacctgtgcataggacaggctgctcattctgctcattctatttctaatgagcagaaatcagactttttaggaaacggtgaattaagttagaagccaagctccaaatgaacatttaaaagtcaacaatcaaagaaatattcctcctggtgtaacagactaagaaccctcccccgccaaaaaaagtagactattctaaaatgggtggtggaaccctatttttccaaggtaaatcatgaaatatacaatttcatttttgcaacaaacacacactggtgttgaaggaggggctacctagtagcctgcagagaccccagcatcatttcctcaggggaggctggggtcagaggcgcgggaggcagccatggagggagacaagaccccttcctgtgcaccctccagcctctgagcctctcctgccaccacgcctttcccactgccagctctggagcattctcttctcagaaggaccttgcaaccttatttctcacgtctttttttctagattccattttcctccctctagtcaccaagcctgtacctccttaagctctttgtactggtttcctggggctgaggtcacaaactgccacagactgggcagcttagacatcagaaatgtatggtctcacagctctggaggctgaaagccgacatcaaggtgtctgcagggctggttccttctgagacagtgcgggaggatctgtccctgcctctctcccaggttcccggagctctggcattccttggcttatagacggctgtcttctctctgtcttctcatcatctgtcctctctgtgtgtctgtctctgggcccaaatttcccctttttatagggagagcggtcatattggaatgggcccatcctaaagacctcatctgaccttgagcaccctcaaagaccttatttccaaataaggtcacatgtctaggtcctgggggttaagacttcagcatcattggaggacgattgaagtcataatcctctttctcctcctcagagcctcacgcctgaattctattcgcagcttatttgcctcattccataacccatgtcttctctagttttaacgtgggtcatgtctgtaataacactcttgagtgcagtggtacaatcaaagctcactgcagcctcgaacttctggactcaagccatcctcctgcctcaacctcccgagtacctgggaccacaggtgcacaccagcacacccacctaatatttttaaaattttctgtagagatgagatctctctatgttgcccatgctggtctcaaactcctgggctcaagtgattctcctgccttggcttcccaaagcactggttttatagacatcagccaccacacccggcccacatttttacaatttaagtgcagttttttggggccagagaacacagataattctatgattgggtatcttaaaaatctcatctgggaggcaacagggttaaataagaggcaaagtcataattggtcactttagccagaagaggaggatgagtgatgattcctgtggttggaacagtctttggcctgttcagtgtcatgtggggtgggggtggtgagtgtatgtgtggtgtgtggtgtgctcatgtgtgtatgtgtgtggtccgtttgagtctggatttgttacggtagtggtggccttccctggagttggtgccttgtgaagttggtgaccaggaggtgcacctgtccagccatggggttcacccacccctgcggctcccaagcctggctgccagtcccagcccagctgggggcaggtggtcggagcagggttaggggtaggggtgagggttagggtcagggagaaccttgcagcctcagcttcccattctcggggtgtagggactttcccagtgcttgtgtgccttccttgtttggtggcatctctaaaccaagaatgtcaacttctgcctttagaaaactcgtgatcctgcctgtgccaccttccagtggcatcatccccactgctgtccactaagtttggggcatctgccctgtgatctctgcaacagccttgtgtccccctcccctgtgaaaaaaagctaaaacacaggggtacaccacttaatcaaggtctcataaatagagctggaccggtgtccctgccccgctccgtcatgcctttgacaaggaaggggctgtggtgtcagtggagagcagggtttgatttcttataagcagctgcctcattgtcatgagaacacccagcctcgtcccgtggctcagcagatgagcgggagcttatgcgcatggctgttccaccagcacgtggggacagcaccgagccgtgccgtggtgtgtgcgcagatcacaccagcatcactgctgccagcctccccaccccatccctgcacctcccaccagctcccccccgcaccctgcagctggtgctttcatccacagggcagcccctctccattcccaatcctgtaatctctcctgacttctgaggcgcacacggctctttccttgtccaaattagcttcctttcctttaacaacgtagcatctcttaaaataacagccattttaccgatgctaaattataacaacaaaatcatgtgtttctttctccacccacagtagaacacaaaagcctgtgccttcgctgttctggagatgaaggcccaggctgatgcaggggagctggcgggtgggaagagagaaatgctcaagcatgtacatgtgccttccagaaccggcttccgtggcattgcttagactgctacacagtctgtcactggctcctgtgacctggctgaccatggcactaggttcctgttcatctctgttgtctttctgttctggatccatagctcagaattccgggaaatgggaaaggaaacagggaagtcgaggcgatctttaacattagtatatattttaagaaataaactgaattttcacacagggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgacccaactgtgaggtttctgagcccccaccagcctcccctcagcagctgaaacatgcagcctctcctgtaggactacagtgacagaggccttgcccggaagttcagagatggctttcccgttccctgcccatttcaaagccttcctgcccccaccagcaacatatacgacacaccttcacacacgtgcacgccccagacgagccagtaactcttatctgtttcaaaattgcctcactctgtccttatgtcttccccccagattgtgacacagatgtgaaaagggccgttggaggtgacagacaggaggccatccagccaggtactctgggaagtgcaggtggctttaggacactagagaactctcatttggtctgctggttaagctcttgcagtatgcgtgggataagaaatattaataatatgtgcaagccacgtttgatttccatggcacaacatagtggcctggtgagcactatacattgcatgaatgacaacctggtagagacggagagacatttaaccaaacccctcttgtcagaaatcctttttcactggaaagcaccagtgcattccaactcagctccacaggcacgtgtgctgccaggagggtccaggcagaggaggctgagcccagcccagacggtggcgaggatgtcaggccaagatgggagcctggtccagattcccaggcacacagacaaaagaaagctccaagagtgactgttcttgcaagagagcctcttagacaaagggctctcacaataccccagctggagtgtcactgctcccagccacaccaaccagaagtgcccacagccttgatttaattttgcaaggtggctgattgctgtggttcact

SEQ ID NO: 1245 - DNA, 5840 bp, Homo sapiens
actgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaa

SEQ ID NO: 1246 - DNA, 7085 bp, Homo sapiens
actgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaa

SEQ ID NO: 1247 - DNA, 81213 bp, Homo sapiens
accaaaaacacatttatatttatgaagaaaacatttcaatagaagcagtagttacatggataaacatgaaaagttatataaacatattaattaaaaaagacaaataatgatacacctatgaaattgaccaagaaggaaaagcacacataattcagagctggtgcaagtgaagtttaattctgcagcaaaatttgaagaggcttttggaaaagtaattcaatgttgtatattaagaagtgtgaatcaccgtatatcaaatggtagattgtctcagggaaaaactgacattcagagtgtattttttgtataattagttttatttctgcataatttataatgttgaaatttttaatgtcactattcactcttaggagaagattgcaattgtgatataattactctgatagatattaactccagtagatactgtccagtcatatacgaacactacatattgcaaaccgaagagatgtaacacagaagattggttagaggtggcaaagggttacagggaaggctggagaagtgggcaggggagtgttgtcatccaaggaccaagagtcctcaccactggagccccatgtgcccctcactgctgagctgatgggaactctgcactccagggctgctgagagaaccctgccctggtgatgtgcagcaacccagatgcctgcatctccccaatacgactgaaactgcctctcaggtgctgaagtctgaggccccccatggtccctgttgcttatagctgctgacccacacccccatcagaaacggaaaaaagtagtttacttcttcctctcaccctgcagtgtccacccacaagggcctgcactctcagagccttacgaaaagtgaagtagcaaagaagtcaggacaaaccacgtgcaggctgcagcactgtgggtcagagactccagccctcaaacgtgcacctaaaaacaggacattgtctagacaaaggtggtcatgaaaagacctccatgatgtaggaaaatgatcaacatttttccagagcacgtctttagagaaaagttcagaggaatttggctgcaagatctaagatggcggtgcagtttcttctgtcttcttccctgttttattccaacagcctaatacagggtatacactcaatgaatatttgtagtttaaagggaagatataacatgtaaagtatcatttttgtctggtttattacattagagtcgattttaaaatttttattcaaccagttttactttagatttttctatgactttaatgacagtatttaaaacaaaaacaaagataaaaatcaaatgcaacactaaagcaataaagattgcaagtgagtgagagggaaacagactacaatcggtcctaatgaagagggagaaagatgaagatatgaagatgactccaattttagttttaatcaaggtactgatttgtggaggtatctttgacacatcagttgacctctgagtttcagattctatacctgtgaaatgttagaataaaaataacaatatcttacaacatttacttgaatattaaatgaagatcacacatatatatggaatatattttataatgtggaaaaggctaaggctgtatatgaactaactcctacatttcataaataagattttgatgatgatgagatttgagattactattactaatattggttaaaagtttgcatttcataacagaggtaaaaattgtaaaagctattagaagaaaaccagaattgttcaggagagatacctactgacttctttagctctcttaattgcattcttcttcaactcccagaggtgatgtatcaaccgaaagctttcaacccctcccctagtgcacacggtaaaaccaggcaggtcactttcttactcctgttggtgctcttaacctggccacacaccaccagcccatctaggtgaggttcaagacatcatctgatggtgagttcagccagacagacaggaggtactagcaggaagaaaagggtcatcactgctctcgacttgttctgcttctgaaacgttctattagttcttcacagcatttcctcattttttctttatcatctgtttttaatggagaaaagcaaatgttattctttcttataacttctatacaacacttatttactgtgacataatggtaaatagatttttaatttccaattatttatggacataataatatatattctatagttttagattttcatacaatgatgtatttattttcctgtcactgaagttttatagaggaaaagtgactgattttcttttgagaggggatgatttctgagggttacaaaacactagaaacaatgtctcaatcattttatgtttctttgatgaaacccacagacagtggcctaaatccaaagtgtagactgcagagggaggatggtgtccctgagaggaatcaggcagagttacgtgcgctggctctctctctcgggctgagacgtgcgttctatctcaggttaggtgtgtgatattaggcaggtaccctgagaacctgcattttttaatatgtaaagagagaaaataataggaagtaactcataggctcttgggaaagaagaaatgtaaagtattaattttagtattagtattagaacaattcctgggatgctgtatgcttcaaataaagatttgactccatttatacttacaataaatccccaagttaaacatgcattaagcaatttacatgaaagtcaaacaagcgggtacagaagaagaatgaacagggggccagttcactgtgtgtggatagtgttcccttatctgtcccgtgtcctggttgagctgttgatagtggcttaatgatagtggcttaatgatagtgatggccatttcctaaagagcagcagagatttcttaggaaaccccgcatctccctgccctcctgctccccctcaatttactgagcaaacaccttttaggtcttcacatgtgctggtcgctcctctggtccttgcttcactttggccacaaataatggacgaggtcagcaggtgtgttttgcagtttattggaatgtttttaaattgtacacagatctcagccaccatttgccagtaggggtagtgtttgatacacattatctatctatctatctatcatcatcatctattcatatatatacatatgtacataaaatgtgtctcagatttgttggatatttatattaaagcaccgaagcatcccagaatgttggaagttttggtgagttgaatgtcttaaatactttttgtaattactacaagaatacaaaatatatttgaaacttgtaaattcattccaaaatgtccctgcatcataatcacagctaaagtcttcccagaaagaggagttattatgtccttattcttggcaagggctctcaaaatttaacatttaatatgtcagaagttgaaaagttggaaagttttaatttctttcagagaaaatgtggaaacagctattatggattatttcagaacggccagatatattttgtgtctattgcccttatttattttgtaactatttaaaaattcaacttcaaatcacatttacataatagttgttccctgaatagactgactgtgacctccttaagtgcactcaagttcaatttttctttgattcatcttctgcatataacacagaggctgtgagtatcatgatagagaaggaaacagtgagttgaagtcagaggcgattcatcgtcagtataacacaggctgtgagtgtcacggtagagggagaaacagtgagttgaagtcagatgcctcagtgttgtttgattttcctccctgcttctcagtttgtatgaaagattgattgtggcaagtaataaagcacatgaggtttgcaaaaacaactaaagccttgtctgataaacagcagtgaccctccaaattctagttcttcctcgctgagatttaatgagctttaaaatgagaggagctttaaggagatgaggttggaggaccacatactaggcaggaaggacataggagtctccaaaaagctctgcataaccagggttaaaataagaaatgttatagttatatattcacctgtgtatgtttacataaatatattatatatatttatataaaaccagagtatttacacataaacacacaaatataaaatccaaattgtttttttttaaagtgggtcatatgctttattttgcagaacttctgccatttttattttgaaagtcagcttcttaaatgtatgaataggtactgaatctggagaatggaagtaatatatcttatataataatagtagcaacaatctcttaggttgtgcagaatagttagcttaaagagttaacatctacactaagagtatatgtgtttattcatcggaaactgtactattctaagcactttcattacatttcctcattttaccctcaccacacctgagctcaaacatgatttttatcctttttgatgtagattggagaaaggaatggcagacagagaaaaaggtggacccatagctggagtctactgtgtgtgggctcctcacttcacgtctctcgatgtctaaagggtcagctgtgtgtgaggacccttccctgctcatgagaatgtgaggctcgctccacgcaatcacagagcctcacagcatggcctgatcctatgggaggaggaggttcaaacatctggcataattttttttccaagttacgctttagttacttgctaaatctttcttatatcatatatacctctgagtattttgaagatgcctattgtttcttaaaccagcgatgttgattcaattcagctgtctatgacaaaaactctacaataaggagtttgctttatctttctttcaatgagtcactgtttgtgttagcagaggagggaggttctgcaaattttcagtacttgttgataaatggcattatcatcaggaaagtttatgaatttgaaccgtgacaaccttactatcagttaccaattcttctggcctatagttgtgaattcttagtttgttttgtgaatttgttatatgtcatttatatactcaaatccccagacccacgggactcaggttagcacaatgagcatacacaaatgtgagtactcacgaaacactcattacaaagggacgcgttacactgactccaaaactctccttggtggcctaggtgaaacctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcagatacttaggattttatccctgttattccttagactctcatacaatgatgcctcatctcatattcatctcattttgaggaattctttcactgtgtggaaactctattttatagtctttgtccatccaaaattcttttacaattgtgttatactaatgtaacatttttggaagttgataactgttctctaattttgtgaaaaaatattcttaacctcaggaaatacttaatatttagagacaaaaaggtcatgaggtgttcaaatgatgagagggaaagagggagggagatagagaggggcaatgaaacaaactgagttcaatgttgctgccacacatgagtatgggtaaagggtatataggtattaattgtactattgttttttaatgatttttgtgaagttgaaatcatttacaaataattaaataccaggcttttctccctttttgaaaatattctcctttctgcttggtggcagtgtgacatcttagaaatcatgctcatttcattatatctaatcattaccaagaaaatccagtcatcgccccttctttattgagggctacatttttctgcatggtccaattctgatggcgtctagtggatttatctctccgaaataattactgccatgtggtgtattgaggatgtaggaccacataagtgactgcagaaaaaatatgacacctgagtggaaggagttttaaggaaggttacctgcccagggtgattcctgagctgagatttcaaacatgtaacttgttatacaaacaagcagagggatggcatcaacattcaatccttcatttatttaacaagcattttgtactattttataattaaaaatagttaaataagattaaattttgaatagcacatggcttttaccaaggagtttgaaaaatacatgtagttgtttatgcaaacaaatgtaagaaaataaataagctgttttgatactcgtgtgaagggtgcagctcataaggacacactaattctatctgtgacatctgagttcaaacaaggagctgagaggagactccggggctcagtgctgaatagtgacgaaaagttaccctcagatgagtgtgtgatgttggagccaggggaacttgctgagacacgctgcaagggaaaaggcacagcatgagcaaagacagggctgagcaagcgagagagatcaatgcccagtagatctttcttatttcatgttaggcttatttcttgcccttgtgtggcccagggttttacaaacaatagtgaaatgatcagatttgtattttagaaatgttatttgtgtggtgatcaattggagatgtgcaagaccaaaaacatagagaccaggtacatgagaatggtaatctaaatgatgttgatctaagtggagtcgaccatgcctttacccgagaataggctgataggagggcatttgaggtggggcctgctgaacctgttacctaaaagcatacatgtggtagctgcatgctataacttcctaattggctatgtacaacttgcgaataatcaggtgttttcaacagtacacattcttcttttctctcaccacactcaattattttatgactataatataaagattctgtagtgctttggaaaaatatgagagaactagtttttaatatttttcctgaactcagacaatataaaatgcatactctaactttgtatgaattaaagagcatttgtcaactctcaatttgctggattataattatagacacatttgatggttatctttaaaacatccttgtgaaaggaaatgtagcaaaatttcatgaaaaatgatttttgtagagctttattgtgctaaaaattgttagctgcctaaaataacctgttataatatgttggtaagtctcgtggtaactacaaagcaaaaacctgtagtagacatacaaaaatttttaaaaaacaaggaatcaatgcataccactagaaaaaacatcatttaaccgtaaaagaagatagtaagaatggaagaaaagaacaaagtctctagaaaacaactggaaaactaacaaaattgtagcattaagtccctatgtatcaaaaattatcttaaatgtaaatgtattaaattatccaatcaaaagatatctggtggcagaatgtataaaaaatgccaactacaacaggttactttaacctgcaaggacatatgcagacgaagtgaagtggttgaaaaggatatcccatgcaagtcgtaaccagaaaagagcaggagtagctatgcttatatcagataaaatagactgaagtccagaactgtagaaagagacaaagaagatcatatataatgattaaaaagtcaattcaacaaaaagtatataataattgtgactatgtatgaaacattaacctaaatacataaagtattaatagatctaaggggatagatagcaataaaataatactaagaaacttcaacacccctctttcagccatggaaagactatccagacaggaggtaaacaatgaaataacagcttcaagttgcactctagggcaatggacctaaaaagcatatgcaaaacattttattcagtagctgcagaatacacattatactcgattgcacatgaaacattttctaggttagatcacatgtttgaccacaaaaaagtcttaaagataagaagttcaaaataatatcaatcatcttttctgatcacagcagtttataaacgaatgcaagaattctcagaaagtttacaaataaatggtgattaaataatatgctcctaaacaatagatgggtcaatgaaaaaattaaaagggaaaataaaaggttgtttgagacaaataaaaatggaaaactcaacataccaaaacctacaggacacagcaaaagcagttcaaagaggaagtttatagtttatagcaatgaatggctacatcaataaagaagaaagacttcaaataaggaaaggtaatattgtaccttaattaactagaaaaacaagaataagctaaactcaaaattagtagatacattaatattgattagaggagaaataaaaaaatgataaaaacaatgcaaaacatcagatgagttgttttgtgaaaaaacaaaataaactagactaagaaggttcaaatcagaaatttacaaaggatatattacaactgaggccacagaaatacaaaagattatgaaagtataatgaataattgcatgtcaaaaattagataagctggaagacatgaattgactgatacataaatcctacgatagtaaatcttagcaaaccaataatgaataatgcagtgaagtagtaataaaagtctcccaccagaaaaaaaaaaaaaaaagcccaggacaatatggactcattgcaaaattctatcaaaaatttaaagaactaataccaattattctcaaacacttccaaaaaattgaagaagtgggaatactttcaaattcattatacaaggccagaattatcctaataccaaagccagagaaggacatgggaatgaaaaaggaactacaggtcaatatcatttgggaacatggatgtaaaattcctcaaaaaatgctagaaaactgaatttaaaagcacatttcaaaaagcattcatcatgataaaatgggattcatcccagggatgcaaggatgcttcaacagatgccaattaataaacatcacatagcacagtaacagaatgaatgatacaattttatgattatttaggtggagagaagcatttgacaaaattccaaaactctcaacaaattaggtatacaaggaatgtatctcaccataacaaaggccatatatgataagcctacagctgacataatacttaatgatgaaatgttgaaagctttttctctaagatccagcaaaagaccagaacggtcactcttgccacttttatgtaacatagcactgaaagtcccagctaaagcaattagggaagaaaaataaatagaaatgtaaataggaaaggaagaagtgacatgtttctgtttgttaataaagtaatattacatataaaaaaacataaagccttcaacaaaaactattccctaacaaattcaggaaagtttcaggaaatcaacagacagaaattggagtttctatactctaacagcaaactgtatctttaaaaagttaagaaagactcatagagaggagttatagcaacaagatagatgaatagaagatcctccagcatcattcatccacacccacaaaaatagaactggaaactattcaaaaacaataacatcctgaattcccatgaattcaggagagaaaaaagagaagctgtgtctggtcttagagcaattaggtaaaagaaggaaacaaaggcctccaaattggaaagaaggaactgaaattttccctgtttacagatgacatggtcatatattaaaaaaatcctaatgacaccagcaaaaactgtgagaactgataaatgaattcagtaaatttgcaagatacaaaatcaacatacaaaattagcatttatatatgccaacagtgagcaatctgaaagagaaataaggcaatcccatttacaaaaactaaagtaaatacaaaataactaggaataaatttagccaaagtaaaagatctcttcaagaaaaactatacaactctaatgaaagaaattgaagagatcacaaataaatggaaagattccccatgttcgtggattagaagaattgatatcattaaaatgtccatctaccaaaagagagctacagaattaaggcaatcactatccgaatacaaaagatattcttcagagatagaaaaaaacaatcctaaagttcatatggaagcaaaaaagactccaaatagccaatgcaattctgagcaaaatgaatgaatatgtaggcatcatactacccgatatactacaagctattaaacatcaaaagagaatggtactggcataaaagcagacacacaaacagaagagaacccctgagagtccagatataaattcactcatttatagtcaactgatgtttgaccaagttgaaaagaacatacaccaagaaaagcactacttcctcaataaatggtgatgcaaaaaatgcatatccaaatacagaatgaaactagacacttatttcactattttaaactcaaattggattaaagactttaatatcagatcttaaactgtaaaacttctggtagaaaacacaggcagaatgcatcatcactacattgatctgggcaagaatttttaaagtagaacctcaaaatcacagggaaaaattaaaaaattaaaaaatgagattacatcatactgaaaggttcttcacaataacgaaaacaattcacagagtgaatagataacatacgagtgggagaaaagatttgccaacaatgcatttgacaaggggttcatatccagaatatataaagaactcaagtaactgagtaccaaaattatcccacaaataatttgatttaaaaaatgggcaaaagacatcaaaaaacatatttcaaaagaagacatacaaatggctagcacgtatatgacaaagtgctcaacatcactaatcatcagggaaaggcaaactgcaatgtcttggatggacatggtatctttcactttgaaactggagtcctgcaggccattttgaatattgttcatgtttcctaacacacccaagttggcagaagaccccctatttaggtctaatacctgctgtttatgctcaaataggcccaggcaatacaagttttggctatgactccagttatgtatatttctggaagaaacaatagatgggtataaaataaagtatggtagagtgaaatcatcatacctgtacaggaatgtaaatttggaggtcatttttcttatcaggacacatcacacggggaatgtgtttctttagtaaatgttgtgtactcctttagatatacttataacaaaccaacgatgcatggcatcaggataagtttagaaataattactaaacgagattccatagggtagagacaagaaattagattttgcctatgttcaagtgggagaatacccatttcaaatacccaagattatagaagaaggaatgaaaaagtttcaactttaagctgctgagggaagcttgaaaagaatttagtctgacatttgatattctttataaccatgtgactaattactcagatggtacttaggaattaagaaaagtcattaacctacaaaaagcccgaagtataagaaaacacagttaaaggtgtgttttttaattgtctttgctggattcggttagttcaatagccttgtcttcaagctctgaacttgtttcttctacttgtttgattctatttctgagattttccagtgtattttgcatttttctagtgtgttcttgatttccagcagttgtgattgttttttatttatgctatctgtttctccggagatttttccattcatgtcctgtaacacatttttaaatttaagttggtattcacctttctctggtactttgttgagtagcttaataattgaccttcttaattctttttctggcaattcagaaatttctcctttgtttgaatccattgctggtgagctagtgtgatctttgggggtgtcagaaaaccttgttttgtcatattttcagaatggttttcctggatttttctcatttgggtagactatgtgagagggaagttctggggctaaagggctgctgttgagattcttttgtcccatggggtgctcccttgatgtggtgctctaccccttcttctagggatgggggttcctgagaaacaaagtgcagagattgttatttctcttccacatctaaccacccagcgaagctactgtgctctggtactggctggtaccggagagtgtctgcaaagagtcttgtggtatgatctgtcttcaggtctctcagccatggataccagcacatgctgtggtggagggagcaggggagtgaagtggactctgtgagggtccttggctgtatttttgataagtttgctggttggtctccagccagcagttgattctttcaagagttgcatcagctgcagtagtgtagggaagatacgagcttgccttagggttacctggataagtatccagatttctcaggcaatgggccgggcctcagagctcccatgagattatgtcctttgtctttggctcccagggtgggtagagaaaggccaagaggtgggggcagtgttaggcgtgtctgagctgagactctccttgggcggggcttgctgtgtggctgctgtgtgggattggggtgtggtcctcagactgatggagttatgtttccacggggattatgagtgcctctgctgggtcatgcaggtcaccagagaagggggggaacgggcagttacatgcttcactcagctcccaggcagcccaaaaggccagtctcactcccaccttgtgcccccagtagcactgagttttttccaggcagctggtgagcagggctgagaacttgccccaggctacaagcccctcatgaagaaagcaagcagggcttttaggtttcatgcctctctgcctgcctcagcttctgagcttgtatctgcactcccagtttgccccctcccccaggttctgtccaggaagcttcacgttagtcaagattattacaaaattcatctgaaagcttgcttctccttgtagtctttccccaattccactggcagccctcccaaaggacccctgcaagacaaagtccgaaatggtttcccacagggctcttcttgttgtttcctctactcgaatattttgcttggctctctaaattcctcttagctccgcgtaagattaaatccttttcccaccatgtggaccgtcaggttccccagtgaggatctgtgcttgggggtggagcatcccccttttacactttcacacattttggcactcagtctttggcacggagcctacagtggccgccacctccttcaaagggtctttggattctcttggctttcctggtatgtcctatggtagttcttggagcaaaagttcacagcgtgaatctccacatgctgctctgtccatccaagtgggagctgcaagttagtcctgcctcctatctgccatcttcctcttctggagtccacgaaaaggattataaacaaactattttgttgggagtaataatgtggtcctggcctagtgtgaagtgaagctcactccaggccatttctctcaagctgtgttaatttgtacccttcagcagtttatgagaggttcatttccataggcccccacatctacaactaggggatttcatatatctaatctgagcagggacattggttctacatggagacagtgcagagatgagctgtgcttgaggcctcacctgtaggtggtagggtctagaccgggagacaggcattggccaacagaaataaaggacacaaagtgatgtccttctccactcacttcagcttttcttcaacactatttcagatgcttccttcctggcttagctcttcattcaaggtgagatattatgggaacaggattgtgggggcaggtggccccaggtatggagactaaggggaggtgtacatggcaagagagaagccagaatatggggatgagaaaggaacaagctgtctgtggtagtcatccatgattgagatgatgtgtggaccctgagtcagactacctggttcaaatgcaggctctctactttttacccatttgatcttggcctgtggctctctacttcttatccatttcatcttggacttgtggcctctcatacctcatcttccttacagtcctccatatgaaatccccctaaagtaggaacaaagctttggccaactgctcctcccatctttccgtggtctttacttaggaactgtgtgtttaatatacgtgacacagggtttctcccacatccctgagcagaaacaagctgtgtctgtattttgcactgtactcacccccatgctaaaccccctcatctacatcctgagaaacaaggatgtggtggggctcttcagaaagttctgggaacacatcaagtctctaaacagaacacataaatatcaatgtggaaaacaacggtagagggccaagatgcaaagacttcaggagcatctcattttccagcatgaggaatgttgctccatcgtatgagaaaaccatttggttcaatttaatttgaaatattaatttgctcataaaaagcttaagggctgggtgcgggggctcatgcctgtaatcccagcactttgagaggcctaggctggcagatcatttaaggtcaggagtttgaaaccagcctggccaacatcgtgaagccctttctctactaaaaatagaaaacttagccaggcacggtggtaggtacctgcaaccccagctacttgggaggctgatgtgggagaatcacttgagcccgggaggcggaggttgcagtgagcagagatctcaccactgcactgcagcctgggacacagagcaagactctgtctcaaaaataaataaataaataaataatgaaaagcttaagaactttttatctagtttctaaccattgtttcaaaatggctgaactcaactgtgtttctccttgaagctagatgataagcatagacaaagttccagtcttctctctttttacctgctttagccatttctcagtatcctttgaagctcaactctgtccaggtattgctaatctccattgttgtaagcatcagcttcctaggaaagacaaaagtgtgatttctcaggggcaataataacacaatagattttcttttctcttgattgctctggaaatcccaacatgttggctctattctcttatcctgtctcgggtggaaacttctggtgattctcagataagcaataactcagctgatatataatacaagaagattttctcttctataataaatacagcaagccttgagtaatagtacgtaatctgtgggtgagcaaggaacaataggcttctctcttgactttgtaagttcctcccattctcactagctctagatgcttactcttcctcgagtcagtgcaggtggaactcaggggatagagtggaagtaggggctagaaaagccctacctaccttccaccaatacagagaagcttcccttcaatttttggtggtttgattataatatgtcttaggggtagttttgtttggattgaatctgattggttactttttacctcactgtacctggttatttatatctttttccaggtttgaaaagttttctattatttcttcatataagctttctactcctttatcatttcaactcccttatctccaatgactcaaaaatttgctgttttgttgctgtccagtaaatctcatgtttcctttattatttttcattcttttctcttctctattttcatataacctgtatttgagttcacagattcattggcttgatccattctgctgttgatggtctcaactgcagtttacattttgttcattatattttgcagctttagaatttgtttgatttttaagttattccaatatttgctaagtttatcattgtggtcatattatttttatcgtttgtttgaatagtttctgtgtattttcttgaagtttgctgagcttccctaagactgttatttcaaatgctttgtcaggtagtttatgcatctccatttgtttgcttggtgatgtatgcttccttgatttctcttgcgtctgcagtcatgcatctaatataataggtacttattccagtctttgcagacttgttttatcctgaaacattcttcaatagtaagcctgtctagagattctgagcaggttgtctggtgtggtccctaagctctagtttgctgtggtgggggcagccctaggtggtgccctaagcctgggactgccacgactggtgcagtgcagtgctgtaatcccatggccactggaactggtgtgggtcccagatgatatcctgtggccactggggctggtgcagcactgatgcaagtctgaagcccatgttcactgaggcctgcctgccagtggatactttccagagcttaaggccactctgggtgggtggcagtgatgatgactgcaaattaattctgctttgcatggtttctgcctagtgttggtgtagatctggaggctcggtctttgtgtactggcctggagtcagtggttgtgggggctgcctggttttcagtttttctgtagtgggcctagtgttgggcaccaagaccaagtcccacacttacttccctttttattccccaagtgtttggtatctctccctgcactgtgctgtctgaggttggggataagaaatgcaggtaatcagaactctccttcctgccctcttcaatgtttattattttatcacaagaagaaaatagtataactaggtacaatgatctctcacatggctttactagcttttgtgaaggtatgtagtgtaagaatagttattaaaattgatgtttctatggggatacaattgttaaagaattccgttctgccagctttcccactctcctctcttttcacttttttgattgagacctttgaagcacaaaaattttgaagttagatgaggtccaattatttattttcttattgctcgttctttcggtatcatgctaaaaaaaatgctaaacttaaggtcttgaatatttaacttcatcttttctcatatttttataattttacttcttatgtttaggtccctgatcaatttgagtttaagtatgatttgtaatgccacttcattcttttgtttgtggatatcttcttgtctgagcacaatttgttaaagtgagtattcttttcccattgaatggacgtggcacacttgtcagatgattattgaccatagacacatgcgtgtatttctcattagattctcaattgtcttctatttatttatgcatatatccttattctgttatcaggcttttaaaattagtgtatctttttggcaaattttgtactcaggaagtgtaaatcttccaactttgtttttctattcaaggttgttttggattttgcagtcgctcgtaatttcatatgatttttagtgttttctactcttgcaaaaaaaaaaaaaaggcatggaatttttataggcattgtattgaacctgtggatatattttggttgtattatcttaaccacaagtctcccaatccattaacatgcgatgttgtttcatcagtttatgttttatttgctattagcagtgctttgtaattttcagtgtgttgtttaacactactttaagtttcttcttgagtaagtgttggtagtttctgtgtttccaggatttggttttcatctcactgaaggtatctagttagtattcaattatttgtaatattctcttataattgcttgtgtttctgaaaggctagttgttatgtacccatgttatattcatatttatgtattcatgatgtaagacttctctctttctctctttggtaagtttacctaaagttttctatattttgttgatcttttgaaagctcgaaatagtcaaattgttttttctattctgcattttattaatctctattccaatacttttttttccttctgtttgctttgtattgagtctgctcttctttttctagttccttaaggtgtaaaaatatattattgtttttagatgtttcttctttttttgagtataggcaatctagctaaaattttccttctaagagttgctttagctgcatcctatatgttttgttatgttttaagtcatctgaatatattttctaacttcatttccaatttcttttttgacccaccggtgcttcacagtgtggtgtttaatccccacatatgtgtaacttttgtagttctccctctatttcagatttccagttttatttcattgattggaaaagatactttgaattaaatcttttaaaatttagtcttatttgtttttggcaatttatcctggagaatgtgttattagtacttgagaagcatctatactctgctatttcagtattctccacatatatattaggtcatttggtttatagtgctgttctagtcacttactactatattaacattctgtctaagtgcactatgcattattgaaaatggacatttaagtattgaactataagtacagaactgtttatttcttcctttaattctgtccaccttggcttcatatattttgggtctctgttacattcattcatgtttacaatttttatatctaaagatctatattacattctccaaggaagatacacaaatgatcccaaacagtatacgattttttttttacttataaaaatttttgtcataaactcactttgtctcacattaacatagccactctggctatctttcggttaccaactgcacgaagtatctgtttatcttcatgtatagtatatgataaaatgttatattcacagataaaacaatttaaagtataaaattatgattcaatatgctttttaatttccttgaacactttcttttcttctaaatctattttctttattcctttatagtttattattttcatatgcttaataaattcaggaatgacaaagttgaaatacaaccaactacatagaagtacaaaaaaccctaagggactattatgaacacctctctgcagacaaactagaaaacctagaagaaatatataaatccctcgaaacaaggaatttatctatttctccacccaagattatttaacctcctgacattaagccaggaagaaattgaaatcctgaacagaccaataatgggttctgaaattaagtcagtgattaaaaaaaacctaccaaccaaaacaagccctggaccagacggattaacaaccaactcctaccagacatataaataagagttggtacaaaatcttctgaaattattttaaaaattgagaagggaatactctctaagtcattctgtgaagccagcatcattctgataccaaaattaggcacaaatacgacaaaaaaaagtaaagttcgggccaacattcctgaggaatatagacacacaatcctccacgaaataccagcaaaccaaatccagcagcacatcaaaaagtgaattcaccacgatcaagtaggctttatttctgggatgcaaggttggttcaacaagtgcaaatcagtaaatgtgattcaccacataaacataattaaatacaaaaatcacatgatcatctcaatagaagcaaaatgatttttcataacattcagcatcctttcttcttaaaaaccctcaatatactgggcaccaaatgaacttatctcaaaaaaataagagccatctatgacacacccacagccaccatcatactaaacaagtaaaatctggaagcattcctcttgagaactggaacaatttgaacaattcagttttcaatttctcatcaaaaattgtgttgacatgattgattgaagtattttatccccctttctcccaaataccaggccacagacagcatgaaatattttaaataaacattaaaataaataagtccagattggtcattaaatcgagtattttttttttattgtataaactcaagatgtacaacatgttttgatgtagatatctatagtgaaataattaccacatgctagcaaattaacacatccatcactgtctgcagtttacttttttgtgataaaaacacatataatctagttattctcttagcaaatttgtaatgtataataaaatagaactatagtccttctgttgtacattagatctctaaatatctttatgttacataactgtaattttgtcttcttttacctacattatcccaatttgtctacttccctgactctggcaactgcccttcaactccctatttatcttactcaatttccatttattttacacataaatgagctcatgctgcatttttctttctgtgcctgacttgtttcacttggcatattgtactccatactttaaaatttattaagcttaaagaattaaacaagtaagctctagttgcctaagaagttaatgtacccagaaatataaatttctcaacaatcatggaaaatgtgttacaactatatcttctttcaagtaggtcttgtaaatattttctgtattaatactgactatgctctcgtttggttgtcattctattctgagtttttaaccctcttgtttaacccaatctctcctcctcaaaaatgaataaatgcattgactcaagaaacatttatttttgagcgtctgttttggaataggtgctatattttaggcattggaaagacactagtgataaaaatggtaaaatgctttatctcctggatcttacattctatggtagagaagagataataatcgcaaaaaaactatcaggaatgataaacattataaagaagagtaaaatagggtgtgtaggagataattactgttttatattcactgctcagagatgtcttctctgataatcaagagagcagagaagagagacctaaatcagttgaagaaatgggtcacaacgtatcggaaaagagaccaccaggcagagagaatagtaatctttttttctttattcagtgtattaaatgcattgtgtttattgatataccccattagtttaatcatattccctcacactttgttattacctttattttaattgccatttttaaatttttgtgatgaacaaataaaattgtatatatttatcatgtacaatgtgatattttaaaatatgtatattgtgtggaatgggtaaattgaggtaattaacatatgcatcacctcacatacttataattctttgcagtaagaagacaaaatcaactctttgcctttatttcaaaattatttcattgtgtggtatttaatattttctatttaacaaaatgtgtatattatgtacaaatacctatgcataaaacatattttataagactaaaatatccttaatttccctctctttacacagtatctactagtttcctagcataaggaagaacagaaaatatttcagaagatatgtctattctcctttccttcatcattcaattgtagccaatatgtttacactagtgcttatcactatttctttacacttgcttttatattttctccatcatctttattattttacaatcactcacaagccacggagcagccattcagcttcgtccccatcactccctttaaattctctcctgactcagggtgattcccatttcacatctttctgttggccgattgtcgtctctttttagtgggtcatcagttctctgaaccgtcatatttctgttttaaaatgttttctcatttataaaactgctttattaaggatttggggttgtagagtatttgaagtttatatcagtatttagctccgatttaaggcaataattttggggtagatttattttttttctatagtatttttggaaagacgttgcattttctaatttcatttttaagaatttgatttgcctttccagttgttaccaggtggattgcatagggcttgcaggcattggggaatattcttgtttctcaagccctacagcttcattgtatgcattcctgctgtcttctccatgttcatttctaccaccttcctattcgtggttatgcctgggatggtgacccccttagtttaggcaagattgtcctgttatctccaccacttctttcccaggtatactccctgcatctatctcttcaataatcctcagattgctacctggctccgtgttcatcaggcttgggtatagcagtttacacttgtgagaggaccctctccttcttggggaataatatttcctggtattttttatcattaccaccaccagtgaccttgactgggtctcttctctgccggacttcctgcttccaatatggagtttctgtaccaattctgatgagtgtccgtgactttcttccccttccttacatgtaatttatagttgatggattgcctttgtctcctgatttcagtgaaggaatcatttgtgcttttttcattttttttgtcttggatgtttattatatcattggagaattaaagtaggataaaaagattggaagactatctaaaagtttgtatcagcaactaggactcccttatgtatgtttgaacagttttgttctgtttgcttttgtgagaaatgagatgaattgatgtgcaaagtgttattagttagggtgcctcaatataggcccaggaaacattggaacaccaaaatggatggagcagacatgagcagaacacaaaaaagaaataaacagcaatatgataatagtaggggattataataccccactctcaacactcataaacaacaaatggacccaaaaataaagacaatttaaaaatatcctgagacaaacaaaaatggacaaataacataccaaatcatggggtacagcaaaagtagttctgatagctactgagacagagagagaaatgatcccaaataagcaacctaacttggcactctgggaattagaaaagaagaaaaaagccaaaagttagaagaaagaagaaagttataaaggttagagcagaattaaacagataagaaagacaaaagaaaagatcagtaacacgaggagttggttctgtaaaaacgtgaggaaaattggcaaacctttaggtagacaaaccaagaaaactaagagagatgactcaaataaaactataagtaaagcaggagaaattagtcaatactaccaaaatacaaagggtcataagagattatcatgaccaattatgtcaataaattgagtaacgtagaagaaatggataaattcttagacatgtatgtcctgaagaaagaataaacctgaacaaattaataactagtacagagattaaatcaccaataataataataataaacttaaaagttcaggacttgatgcttttactggtgattgctaccaaatatctaaagacagattaatgctattctcaaacttttccaaacaattaaaaagggtgcactttccaacacattttttcatgcattaccctaacaccaatgtcagacaaggacggtataagaaaattacaggccaatttattttatgatcatggatgtaaagattctcaacactagcaaactgaattcaatatgttcaaaagatcatttagttgaatgttttctttcttctgaaattcttcattttgcttccaaatgtcatttttccttatattttattttttcattaatcaaatttaattttaaaatttccaactaaaaaaatctgtgggtttaataaacatatttttaattaacatttaaaaaaagcacaagtttgtaaattgtatattttctgtccattagattttggtttgagtattgggccaattgcacggtaagctttttaatttttttccagaagtaatcccaggaccttaaatctccactgaaactctcgaagtttaattggtcagctgggattgtagtccctggggtgttgaaagcataaataagccataccttaagtctggaccatttatccctgtagggagtccctcttctcctctgttctctttcagaactacttattactttaggttcagtgtatgtagcatatggtgactctatgggtttcagttttctgaaccccaaatatgcaaaaatatagaaaaagcagaccaggcatcccaccttctgtgtgccactaagggagcatctcttcctctttctcccctaataagttgtatattattttctcagtattttaattttttgctatttatattatctgagatttatcattggaatcatacaaatattaaaccaggaaagatcacccaggaagaaattgagatcacccacaatatcaggtattctaaaacatgttatatgaaaattgtaataattaaaacatgaatcacaaatcttgcaggtagaaatgtcaacatattaatttttttgaggaagagcaacttggatgaatatatggatgtaaacttgctgatcaactacagccaaaaattacattgtaattgtaacgtgtccctaaacttgacccattaccaatcctgataagtctgtgcttaggattatgtagattttcaaaggattgaaatgtagttgccttttccaaatcttgactagcttgtctgacaaggtaggatcatgtcaagtagattggactgaggtgatccctttattttaaagagcagtctttggcaaacactgatactagaaactgatatgattttgctcttgttgaagaattttacttattataaatgttttttaaaaacaagggaaggaaacataatcttaaaaccactcatttgtgtccatccacattatactgtagagaagactgacttttttttccaggtgattattgtagcaaaacattttaagttttattgagatcgtttgtcatgtctaaatttgttcatcataatatatcctgagcttagttcagtgcctggctcatgataaattttatttatttagtgtggtgagagcacttaacaggaaatttaccctcttacactttttcagtgcacgattcagtactgtgaactccaggcacggtgctgcacagccaatctctaggacttcatcttgtgtcactgaaaccttatacccattgcacagtagatcaagagaagaaatacttgatacacggcacaagacctatagaacacgcagggaaaacttcttctggcatcagaaaacctgttcattgctgagttcattcattatattcacctccttacaccacaatgctaacccatgaatctaactggctgtgacaaaactgtctttcataaacctacagactttaagatttatggaaagagaaagacctgtggcatcctagaattctaacatccactcttggatcatcatgaccacttagcagagctttgcattgaattccagataaagaatatcaaactcaaggatatagcagctcttgaataatgggaaagataaatgaagtgtttggcaagtagaaagataatcatgaagttcagtcattaaagtctcgccctgaacaaatgccatggacttgacatcataaaaaacataaaataggtataagtcaaaaatgtttattttgggaaattatatttaaatcaaaatcaaaaatatactcatctgaaagacaacagaaagttctgtcaccaagggaaataaaactctaattaccaaaacaaaatgtaaacaaaataaaacttacataaatatatacattcatgcattcaaaagaagttgcatagaattttatttagccatatctcagtattttggaattttgcaaacaccaagagtcgcaataataatacataatcttcgtctctcactctgttattttttcctcaagcttgggaaagataatgtgtgagtggatagagtgattctggggatcgggatgagacaattctgcttaaggcaacttctcttaggatggcaggaggtagcaagagaagaaagggcagaataaccattacagtttacaccatatttatagctataatgccttaatataatatgaagtaattactttcaattactttttaataacagagatatatacaatatatattctttaaaatggttatctaaaagtttaagaaattaaaaaaccttaatcttagaaattatctagaaatttaaatttctgaattataggtaaatgtgttatgattttcttttttcaaataagccttacaaatattttcaatattgatactgtttcattttaaatgtgccactaacatgatgctgtcatttcattgtcattctagcagtaaggattctgagtccttagcactctgtttgacccagcctctccttccaggaaatgactaaatatactcattcagagcatatttatttttgagcatctactttggggctaccactgtgttaggctttcagcacacagcagtgataaaaatgagcaaaatgtctcatcttattaatatgacactatattgtggaaaagagaaacaattgtaaaaaatatgttcaagattgttaattttatgaagaaaaataagacagcataagggacagatcagtcatttttattcattggtcattgaaatcttttctgataatcgaatagcacagaagagacctaaaagaactgaaataatgggttctagtgtatctggggaaaacgactcaaggtaaagggaaccatcatctttttcagatggcactcagagccataagaggttcagatagatccacccagcagtgagtgcagtgggtttttctaggcagaaaacacagaagaaacatcaagaaatcacatgattggcttgccatgtccaagtccttttctaattttgtttttctttttaaagcatattttttgcctgctaccatgacttgtaatttttgatgatgttgttgaaagctgatgtattcatttgctatgcgtaccatagcattctggtagtttgatgacaacctttggcattccttggcttgaagtagcattacttcaatctattcctttatcttcaaaagataatattcctgggtgcatgtccaactttttttaaataaggacaccagtttcaaaggtaaagcccagacactggttaaggtagtgaggacagattttaattagtaacatattttggggtatttgtgggtttttcacctaaaatgtaatcttacacaggctgtagattatatctctgtttccaggaagccccgtgtgttgctttgtgtgtgcatcagtctctcgagaaccccctgtgaatcaggaggcatacgttccagtgactatagggagtcgaggggctaaagaggtaagtgaaacatctggtaggggtaaaaggatgggtatatatcaaaagtcaggggtgtttaatggaaaagaggtgcatatcaaagtgtcaggggagttcaatggaaaaagttaagatggtaaaagaaagaaggaaaaaagaaggaaatgggaagggagcagtcctataagagccactttaggcagatcttaagattttcaaataaaccattgcagttccgaattatccacagtaaagtcattttgcctaaaatagaagcagacatggttagtgtcatagtatatatagagagtaggaacccaaaaggggtttaactgtggagttcctgtgggaagagtaagttcaaatagaatgaagaggtctcacaagaagccagagtgaacattccagcacaggagttaggaagtgaattcccactgaaaacagggagccaggaagataaacagccagcccaggagatgtctttcaaaagcagcctggaattataacccagccttagagactacagccagaaacataggaagaaaatatgtcctcgccatgcctcagtgcaaatttctacacagtgttaggccagaagttgaactcgccaccaaatacccaaaaaagtaagtcaactgaagatcagacaaaggtttctacgcatgcagaaaggattgactgttttgtccaagggccagataagggttccaatctggatttgagttccagtgccagataactgtcaagacaaacaaaatggaaaactggttaaagaggtaagaacgtgctttaactagtcatatactattgaaacaggcaagagttcagcatgaacttaactttgatgtatccaggttgaggaaaatgttaaagggagtttgaggaaagagaaatgggagttagtgggggctcaggagggtcagggatgtgagaaattacaaatcgtgagaaggggggagttggttcctgtgaaacccatttgctttgttaactgatacttgctgatgttgggcttctaccctcccacagaggtcaggagacaccaggcctatcttcaagtcttggctgggacaagcatgctatagattgtctgtgtacttacataagttatatgttgaaatcttaaaccccaatgtgatgatattgggagaggaagtctttgggggttgattagatcatgagtgatgaactcatgaatggccttagtgacctcataaaagagactccagagagctttcttgcctcttctgccatgtgagggcacagcaagaagaccatgctctataaatcagaaaatgggtccttacagaccaaactggctggcacctttattgtggactttccaatctgtggaaatgtgagaaataagtgttgtgtaaggccatggtatttttgttataggaaccatgaagacaggcaggtttcagttttctcagacagttcactttaagggagactgggtcgttcgttctagagatgtagacttgaactgttaccaactatgttcctgtctttttcaagtttttatagaccaaagttaaggctgaattgagaaggctcagaagaccctggctagagtttcgtcaagtttaaaatgatcgtcaactctgtatacatcaaaattgagttcagtgcgtgctggactgttttctctgtttcaatagtatatgactcattaaaatatgttgttactactttttcttcaatcatattggattagggacactttctactagagtatgttctcatcttcaattaactaattacatctgcaatggtcctatttccaaataagggtacattctgagatagttgggggtatgacttcaatatatgagtctgtggggatacaattcttaccataatttacatgatgtgttaggtaaagataaacaggcgtttagtgtgaagtttatgtttatgtgttaggctatgtttatcgctagttttacctctgatgtcagaggccataatttgctctagtgttcttatttttgtgtcctctgttatctttggcttttctacagattcattgttaaacaggatttgaggcttgtcatccttccatgtgcatcctctgttatcatacatgagatattttaatgtgtttgtcagtgtggaagggagagaaatcattctatagtcctacaaattggtctgaatctatttgccagcatgtgttcttggactgcaaccttcaaagagcttcttaacatcccctgcccacccccacataggtgtgacacaggttagaaggacctggagttgggtattttccttctagcatattggttagcctgtggtaaaaccccagtaatacggcagcctctgttaaatagtttattttttttaattatactttaagttctagggtacatgtacacaacgtgcaggtttgttacatatgtatacatgtgccatgttggtgtgctacacccattaactcgtcatttacattaggtatatgtcctaatgctatccctccctcctccccccaccccacaacaggccctggtgtgtgatgtcccccttcctgtgtccaggtgttcttattgttcaattcccacctataagtgagaacatgcgatgtttggttttttgttttgcaatagtttgctgagaatgatggtttccagcttcatccatctccctacaaaggacaagaactcatcattttttaaggctgcagagtattccatggtgtatatgtgccacattttcttttgtgtgtgtgtttttttttttgttttgtttaagtttttcttttattattatactttaagttttagggtacatgtgcacattgtgcagattagttacatacgtatacatgtgccatgctggtgcgctgcacccactaactcgtcatctagcattaggtatatctcccaatgctatccctccccccaccccacaacagtccccagagtgtgatgttccccttcctgtgtccatgtgatctcattgttcaattcccacctatgagtgagattatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgggtcttatagcagcatgatttatagtcctttgggtatatacccagtaatgggatggctgagtcaaatggtatttctagttctagatccctgaggaatcgccacactgacttccacaatggttgaactagtttacagtcccaccaacagtgtaaaaatgtttctatttctccacatcctctccagcacctgttgtttcctgactttttaatgtttgccattctaactggtgtgagatggtatctcattgtggttttgatttgcatttctctgatggccggtgatgatgagcatttttcatgtgttttttggctgcataaatatcttcttttgagaagtgtctgttcatatccttcacccactttttgatggggttgtttttttcttgtaaatttgtttgagttcattgtagattctggatattagccctttgtcagatgagtaggttgcgaaaatttcctcccattttgtaggttgcctgttcagtctgatggtagtttcttttgctgtgcagaagctctttagtttaattagatcccatttgtcaattttggcttttgctgccattgcttttggtgttttagacatgaagtccttgcccatgcctatgtcctgaatggtactgcctaggttttcttctagggcttttatggttttaggtctaacgtttaagtctttaatccatcttgaattgatttttgtataaggtgtaaggaagggatccagtttcagctttctacatattgctagccaattttcccagcaccatttattaaatagggaatcctttccccattgcttttctcaggtttgtcaaagatcagatagttgtagatatgcggcgttatttctgagggctctgttctgttccattgatctatatttctgttttggtaccagtaccatgctgttttggttactgtagccttgtagtatagtttgaattcaggtagtgtgatgcctcgaggtttgttcttttggcttaggattgacttggtgatgtgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatagaatgttcttccatttgtttgtatcctcttttatttccttgagcagtggtttgtagttctccttgaagatgtccttcacatcccttgtaagttggattcctaggtattttattctctttgaagcaattgtgaatgggagttcactcatgatttggctctctgtctattgttggtgtataagaatgcttatgatttttgtacactgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatcctgtcttgtgccagttttcaaagggaatgcttccagtttatgcccattcagtatgatattggctgtggctttgtcatagatagctcttatgattttgaaatacatcccatcaatacctaatttattgagagtttttagcatgaagggttgttgaattttgtcaaaggccttttctgcatctattgagataatcatgtggtttttgtctttggctctgtttatatgctggattacattgattgatttgcttatattgaaccagccttgcatcccagggatgaagcccactcgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccttctttttctattgattggaatagtttcagaaggaatggtaccagttcctccttgtacctctggcagaattcggctgtgaatccgtctggtcctggactctttttggttggtaagctattgattattgccacaatttcaaatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggataggtggtgatatcccctttatcattttttattgcttctatttgattcttctctctttttttattagtcttgctagcggtctattttgttgatcctttcaaaaaaccagctcctggattcattaattttttgatgggttttttgtgtgtctatttccttcagttctgctctgattttagttatttcttgccttctgctagcttttgaatgtgtttgctcttgcttttctacttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatatacccagtagtcattcaggagcaggttgttcagtttccatgtagttgagtggttttgagtgagattcttaatccttagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgggatggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgagtgctcctctgttgggtgcatatatatttaggatagttggctcttcttgttgaattgatccctttaccattatgtaatggccttctttgtctcttttgatctttgttggtttaaagtctgttttatcagactaggattgcaacccctgcctttttttgttttccatttgcttggtatattttcctccatccttttattttgagcctatgtgtgtctctgcacgtgagatgggtttcctgaatacagcacactgatgggtcttgactgtttatccaatttgccagtctgtgtcttttaattggaacatttagtccatttacatttaaagttaatattgttatgtgtgaatctgatcctgtcattatgatgtcagctggttattttgctcgttagttgatgcagtttcttcctagtctcaatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcatttaggaagcttagtttggctggatatgaaattctgggttgaaaattcttttctttagaatgttgaatattggcccccactctcttctggcttgtagggtttctgccaagagatccgctgttagtctgatgggcttccctttgagggtaacctgacctttctctctggctgcccttaacattttttccttcatttcaactttggtgaatctgacaattatgtttcttggagttgctcttctcgaggagtatctttgtggcattctctgtatttcctgaacctgaattttggcctgccttgctagattggggaagttctcctggataatatcctgcagagtgttttccaacttggttccattctcaccatcactttcaggtacaccaatcagatgtagatttggtcttttcacatagtcccatatttcttggaggctttgctctttttattcttttttctctaaacttcccttctcacttcatttgattcatttcatcttccatcactgatagcctttctccagttgattgcattgcctcctgaggcttctgcattcttcatgtagttctcaagccttggttttcagctccatcagctcctttaagcatttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtgaggaactgcgttcctttggaagaggagaggcgctctgctttttagagtttccagtttttctgttctgttttttcccatctttgtggttttatctacttttggtcttcgatgatggtgatgtacagaagggtttttggttttctcccattctatagcttgcctgttcactatgatgatagtttcctttgctgcacagaagctctttaattagatcccatttgtcaactttggcttttgttgccattgcttttggtgttttagtcatgaagtctttacccacgtctatgtcctgaatggtattgcctaggttttcttctagggtttttattgttttaggtctaacatttaagtctttaatctatcttgagttaattttttataagatgtaaggaagaagtccagtttcagttttctgcatatggctagccagttttcccagcaccatttattaaacagggaattttttttcccattgcttgtttttgtcagttttgtcaaagatcagatggttgtagatgtgcggtgttatttccgaggcctctgttctgttccattggtctatatatctgttttggtaccactaccatgctgttttggttactgtagccttgtagtatagttcgaagtcaggtagtgtgatgcctccagctttgtcctttttgcttaggattgtcttggctatatggcctttttttggttccatatgaaatttaaagtagttttttctaattctgtgaagaaggtcaagctagcttgatggggatagcattgaatctataacttactttgggcagtgtggcatatatatccaaaggattataaatcattctataaagtcacatggacacatgtttattgtggcactattcacaacagcaaagacttggaatcaacctaaatgcccatcaatgatagactggataaagaaagtgtggcacatatacaccatggaatactatgcagccatagaaaaggatgcattcatgtcctttgcagggacatggatgaaggtggaaaccatcattttcagcaaactaacacaagaacagaaaagcaaacatcgcatgttctcattcataaatgggagttgaacaataagaacacatggacacagggaggggaacatcacacaccagggcctgttggtgggttggggggctaggaaggagggatagcattaggagaaatacctaacatagatgacaatttgatggctgcaggaaaccaccatggcatgtgtatacttatgtaacgtgcacgttctgcacatgtaccctagaacttatagtttaaaaaaaagtttgctttggctttcgatgtaattctacttagacaactcttatacatatagagtaacatgtacacacatttcattttacaaattctcccttttattttgacttggcatttgacaatatcactttgatagtagcttgtgaatattagtcaagatttgtatagaggtcgggcacagtgactcatgcctgtaaccccagcactttgggaggctgagtcaggtggatcacttgaggtcagttgttcaagagcaccctagccaacatggtgaaacaccatttgtactaaaattacaaaaattaggccaggcacagtggctcacgcctataatcccagcactttgggaggctgaggtagttaggtcacctgaggtcaggagttccagaccagcctggccaacatggtgaaacccccatctctactaaaaaaaaatatatatatatataaaaatatatatatatacacacaaaaattagcgggcatggggcctgtgcctgtaatcccagctacttgggaggctaaggcaggagaattgcttgaacgtgggaggtggtttgcagtgagcagagattgtgccactgcactccaccctgggagacagagtgagattccatctaaaaaaaaaaaaaaaaaaaaaaaaatacaacaattagctgggagtggtggcacacgcctgtagtctcagctactcttgaggctgaggcaagagaattacttgaacccaggaagcagaggttgaagggaacagagatcacggcactgtactctagtccaggcgacagaacgactccatctcaaaaaatatatatatttgtatacatataacaaaatatttgcatcaaaaggacattgggtcagttgctttacctgcataaatacatcatttgaacatataaatatatcggtgtaaaaatgggcaaagtacaagaataagcaaagagtgaataaatacaaatatcaaataaaacaaatgttaatacaatacttttgttgtttgagtaaaactttattcaataaaaatagaaggaagtggcatttcccgcccatggatttatgttgaggaaagttctataggtcttcacaacatgttttaggtgatatataaggaagataattatactgtaaacgactgtggattaccattcttgacctcattactttctatccccaaatattaatcacttagtatttgaagctgaagagtcctgaagctgcaggaaaaatggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactaggaaacacctggaattctaaacaagggaaacacctcaaggcagagtgagggttcatcctccccagacattcctcttgtcaatcccaaagccacagggactaggaagcattggaattctaaagaagggaaacacctcaaggcagcgtgaggattcatcctccccagacattcctcttgtcaatcccaaagccacagggactaggaagcattggaattctaaagaagagaaacacaccaaagcagcatgagggttcatcctcccagacattcctcttgtcaatccaagaccctgtgttctatctggaaaaaaatgtttgtccttcatccacctgccatcaaggttcatgtatccattatttccttctaatgtgccagcccatctgatagacttctactaatgcttcaaaactcagctgaaatgtcacctgcactcactagctgtcctgaaacaccatccttctcatccttgtgcagaattaactgtttcataatatgtttccatagcacttgatccacactaccatttctacatttcacatttgagatatatgtatacatatatctctaactaggcaaagcaatgtatataacagactgaaaaaatacatgaccattttcccagaatatgtcacttttaactggagaatggaaccatcccactctattggcttatttacaacacgagaaacacaaatattaagagttgtgatgctttggttccacagaattgtgggatgcaaataatgactaatattttattaaaggaatcaaataagcaaacttgaattaaggagattgattaaaagttgagtaaaattgccatatactaaaatgtgttttaacatttatacaaaattcataaaataagttattgtttttggccttaaactctggaaaacagttacttatgtaattttatacttcaaaaatttgaaatatgaatcccacacactgtctcacgttaacgatcatagttatatgtttggtttccaaaacagcaaaaaaaatgaaatatttagaagcattttaataaatgtattcttatatttgaccaaacttttactttctgatttaattctgtctctatctctctgtgtatctttgtgtgtctcagcctctttcttgctttcttttcccaaaacgattgaacttcatcaattcgtcaacctcaagtattttaagagaactgtgcaattatagaaaaaagtgatttaatctgtggttgtaattttacttcatattctcattatgatacacatgaaaaaagcatgaaaacatcaatgcaaatgaagagtaaaatgcaggcagaatctggggtggaagtggaattttcaagtgatttagacttttcttttttggacagggtcttgctctgttgcccaggctggagtgcagtggctcaatcatggctcactgcagccttgacctcctgggtttaagtgatccctctgcctcagccttccaacattcagatttataataattcatcctggtgtgagaatattgtagcctgtctacgaatgttaaggataacgtttggacctgcctctcctaccaaagcctggactgaaggcaaaatggctgcgcacacaagaacaaaaaggcatcaggagaattcactaatgactcaggctgcctcttcacaaataccctgtccagctggcacctcttcaatatacttttagcaaacaaaatgatgaatatccaatttaacaaaaacgagggaaaagaagcctggttaaatttgtcttctaggatattcttatgtgattttcctcctccagtaatggagaggagagttgggaactgagcagaacatgctgaggagcacatgtttttatttacaatatgcaagtagagaagtagttctacaggaagcgtcacatgtacaaatgcattattcctgataacccgagcaacacagcataggaaagaatgtacctgtgtcagagtctcaatcaatttacatggaatatggccccagggcaaaagatgtggcatttaaaggaaagaaatagctccaggtgaaaagacaaccatgtgtaaagcaatgatatgaacacaatatgtagaaaaacctacatatgaattgtgaagcaaccattttcaaagacaaactcacatccatttaaggtaatatggaatacaaatcccactgaaaataaaatcaaattattactgtatacaataaattcaaacataattcagaaaaaaatagaatatctgcttattgctgaaattagcatctttagctgtaagttatttgcacccaaaaggaaaccagaaaataatagatataacataggcaaagcaacctaaaaaaactacttaactgcagatgaaaatgggaacacatttgaaaataaaatcctgttactactttcttgaatttagagctttcctatgatatggatatgtttatactgcttttataatcatcatacatgtataatttcatactatttttatttataatgtgagcatttttctgattaatctaaaaaatatccaccatttattaaaaatcttccctataattgaataacatgagtagtttctcttttttaaatacctacattgagcatacttttgtttgtgaatgcttataattatgtacttataatgtattttataaatacaattagtaaatctaaaacaggtacacatcagtcaatttgcacacattactagcttgatctgcagaacacgttttcaaaggatgcgccaagaaaaaaactatcacttagttaaatgaccattcagtattgcaattatttaaaaactatacaatgagaatgctgtaataagtatatggttccaccactccaaacaccatgaattttttttaaaagatatttttaagaaaaaataaaatgattttacataacaaatattaatgaattcatgaaaaacaaaaaccatataggaccacagctcagagaagaaaaatgggaggcacttactatttaaaccctaacccaaatggtcagtaaaaagacaagtaccagctactacaaaaaaacaccaaaatataaagaccaatgatactgtgaagaaactgcattacctaatgtgcaaaataaccagctagcatcacgatgacaagatcaaattcacacataaaaatattaatcttaggcagggcacagtggctcacacttgtaatcatagcactttgggaggctgagtcaggtggatcatgaggtcaggagttcaagctcagcctggccagcatggtgaaaccccatgtctcctaaaaaaaatacaaaaaattagccaggcacagtggtgcatgcctataatcccagttactcaggaggctgaggcaggagaattgcttgaacctaggaggcagaggttgcagtgagccaagatcgtgccactgtactccagcctgggcaacagagcaagactccatctcaaaaaaaaaagaaaaaaatgtatatgttatcactttggtctcatttgagtatgaatgatcagacagggaaaataaaagtaccaagaaaaataaacaagggtcttataataaaagcaacacagaatggccaaagctatcctgagcaaaaagaggaaaaaagctggagccatcacattactagacttcaaaatatactaccaagttatagttaccaaaacagcctggtattggcataaaaacagacacatgggccaatagaacagaatggagaacctagaaatagattcatgtatttacagccaactgatttttgacaaaggtgccaagaacatacactggggaaaggagagtttcttcaataaatgtcctggaacagtaatcagcagctggggctggtaccatagggatacttaaagttgaatttatcaattgctggaagctcatgtgaactaacttgacaaataaaaaaaatgttgagccccagtcttaggaaatcctccctatactcatgatttttaccttcaggagtctcaacagcttctcactgtgcaaagtagagagaaattcccttttgctttggcagagagaggagaaaataaacatttgaaatatgcccagagctctctgttcaccataacctgatctcagtagtaactatttaatgattgccattctaactggtgtgagatgatatctcattgtggttttgatttgcatttctctgatggccagtgataatgagcattttttcatgtggctgtgggctgcataaatatcttttgagaagtgtctgttcatatctttcgcccactttttgatgggttttttttttcttgtaaatttgtttgagttctttgtagattctggatattatccctttgtcagatgagtagactgcaaaaattttctcccattctctaggttgcctgtacactctgatggtagtttcttttgctgtgcagaagctctttagtttaattagatcccatttgtcaattttggcttttgttgccattgcttttggtgttttagacatgaagtccttatccatgcctatgtcctgaatggaattgcctaggttttcttctagggtttttatggttttaggtctaacatttacgtctttaatccatcttgaattaatttttgtataaggtgtaaggaagggatccagtttcagctttctacatatggctagtcagttttcccagcaccatttgttaaatagggaatcctttccctatttcttgttttgtcaggtttgtcaaagatcagatagttgaagatgtgtggtattatttcggagggttctgttctgttccattggtctatctctctgttttggtaccagtgccatgctattttggttactgtagccttgtagtatagtttaaagttaggtagcatgatgcctccagctttgttcttttggcttaggattgacttggcgatgcaggctcttttttggttccatatgaactttagttttttccaattctgtgaagaaagtcattggtagcttgatggggatggcattgaatctataaattaccttgggcagtatggccattttcatggtatttcttcttcctatccatgagcatggaatgttcttccatttgtttgtatcctcttttatttcattgagcaaacaggtgctggagaggatgtggagaaataggaacacttttacactgttggtgggactgtaaactggttcaaccattgtggaaaacagtgtggtgattcctcaggtatctagaactagaaataccatttgacccagccatcccattactgggtatatacccaaaggattataaatcatgctgctataaagacacatgcacatgtatgtttattgcagcagtattcacaatagcaaagacctggaaccaacccaaatgtccaacaatgataaagtggattaagaaaatgtggcgaagatggccgaataggaacagctccggtctacagctcccagcgtgagcgacgcagaagacaggtgatttctgcttttccatctgaggtaccgggttcgtctcactagggagtgccagacagtgggtgcaggtcagtgggtgcgcgcaccatgtgcaagccaaagcagggcgaggcactgcctcactcgggaagcgcaaggggtcagggagttccctttcctagtcaaagaaaggggtgacggagggcacgtggaaaattgggtcactcccacccaaatactgcacttttccgacgtgcttaaaaaacagcgcaccacgagattatatcccgcacctggctcggagggtcgtactcccacggagtcggagtctcgctgattgctagcacagcagtctgagatcaaactgcaaggcggcagcaaggctgggggaggggcacccgccattgcccaggcttgcttaggtaaacaaagcagccaggaagctcgaactgggtggagcccaccacagctcaaggaggcctgcctgcctctgtaggctccacctctgagggcagggcacagacaaagacagcagtaacctctgcagacttaaatgtccctgtctgacagctttgaagagagcactggttctcccagcacgcagctggagatctgagaacgggcagactgcctcctcaagtgggtccctgacccctgacccctgagcagcctaactgggaggcaccccccagcaggggcagactgacacctcacacggcagggtactccaacagacctgcagctgagggtcctgtctgttagaaggaaaactgacaaacagaaaggacatccacaccaaaaacccttctgtacatcaccatcatcgaagaccaaaagtagataaaaccacaaagatgggaaaaaacagaacagaaaaactggaaactctaaaaagcagagcgcctctcctcttccaaaggaacgcagttcctcaccagcaacggaacaaagctggatggagaatgactttgacgagctgagagaagaaggcttcagacgatcaaattactctgagctacgggaggacattcaaactaaaggcaaagaagttgaaaactttgaaaaaaatttagaagaatgtataactagaataaccaatacagagaaatgcttaaaggagctgatggagctgaaaaccaaggcttgagaactacatgaagaatgcagaagcctcaggaggcaatgcaatcaactggagaaaggctatcagtgatggaagatgaaatgaatcaaatgaagtgagaagggaagtttagagaaaaaagaataaaaagagcaaagcctccaagaaatatgggactatgtgaaaagaccaaatctacatctgattggtgtacctgaaagtgatggtgagaatggaaccaagttggaaaacactctgcaggatattatccaggagaacttccccaatctagcaaggcaggccaaaattcaggttcaggaaatacagagaatgccacaaagatactcctcgagaagagcaactccaagaaacataattgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattctaaagaaaagaattttcaacccagaatttcatatccagccaaactaagcttcctaaatgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccattgagactaggaagaaactgcatcaactaacgagcaaaataaccagctgacatcataatgacaggatcagattcacacataacaatattaactttaaatgtaaatggactaaatgttccaattaaaagacacagactggcaaattggataaacagtcaagacccatcagtgtgctgtattcaggaaacccatctcacgtgcagagacacacataggctcaaaataaaaggatggaggaaaatataccaagcaaatggaaaacaaaaaaaggcaggggttgcaatcctagtctgataaaacagactttaaaccaacaaagatcaaaagagacaaagaaggccattacataatggtaaagggatcaattcaacaagaagagccaactatcctaaatatatatgcacccaacagaggagcactcagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcagacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactaaggattaagaatctcactcaaaaccactcaactacatggaaactgaacaacctgctcctgaatgactactgggtatataacaaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaagtagaaaagcaagagcaaacacattcaaaagctagcagaaggcaagaaataactaaaatcagagcagaactgaaggaaatagacacacaaaaaacccatcaaaaaattaatgaatccaggagctggttttttgaaaggatcaacaaaatagaccgctagcaagactaataaaaaaagagagaagaatcaaatagaagcaataaaaaatgataaaggggatatcaccacctatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatttgaaattgtggcaataatcaatagcttaccaaccaaaaagagtccaggaccagacggattcacagccgaattctgccagaggtacaaggaggaactggtaccattccttctgaaactattccaatcaatagaaaaagaaggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcgagtgggcttcatccctgggatgcaaggctggttcaatataagcaaatcaatcaatgtaatccagcatataaacagagccaaagacaaaaaccacatgattatctcaatagatgcagaaaaggcctttgacaaaattcaacaacccttcatgctaaaaactctcaataaattaggtattgatgggatgtatttcaaaatcataagagctatctatgacaaagccacagccaatatcatactgaatgggcataaactggaagcattccctttgaaaactggcacaagacaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaatcagtgtacaaaaatcataagcattcttatacaccaacaatagacagagagccaaatcatgagtgaactcccattcacaattgcttcaaagagaataaaatacctaggaatccaacttacaagggatgtgaaggacatcttcaaggagaactacaaaccactgctcaaggaaataaaagaggatacaaacaaatggaagaacattctatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccacatcaccaagtcaatcctaagccaaaagaacaaacctcgaggcatcacactacctgaattcaaactatactacaaggctacagtaaccaaaacagcatggtactggtaccaaaacagaaatatagatcaatggaacagaacagagccctcagaaataacgccgcatatctacaactatctgatctttgacaaacctgagaaaagcaatggggaaaggattccctatttaataaatggtgctgggaaaattggctagcaatatgtagaaagctgaaactggatcccttccttacaccttatacaaaaatcaattcaagatggattaaagacttaaacgttagacctaaaaccataaaagccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcaaaagaaactaccatcagactgaacaggcaacctacaaaatgggaggaaattttcgcaacctactcatctgacaaagggctaatatccagaatctacaatgaactcaaacaaatttacaagaaaaaaacaaccccatcaaaaagtgggtgaaggatatgaacagacacttctcaaaagaagatatttatgcagccaaaaaacacatgaaaaatgctcatcatcaccggccatcagagaaatgcaaatcaaaaccacaatgagataccatctcacaccagttagaatggcaaacattaaaaagtcaggaaacaacaggtgctggagaggatgtggagaaatagaaacatttttacactgttggtgggactgtaaactagttcaaccattgtggaagtcagtgtggcgattcctcagggatctagaactagaaataccatttgactcagccatcccattactgggtatatacccaaaggactataaatcatgctgctataagacccatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcataatctcactcataggtgggaattgaacaatgagatcacatggacacaggaaggggaacatcacactctggggactgttgtggggtggggggagggatagcattgggagatatacctaatgctagatgacgagttagtgggtgcagcgcaccagcatggcacatgtatacgtatgtaactaatctgcacaatgtgcacatgtaccctaaaacttaaagtataataataaaagaaaaacttaaacaaaacaaaaaaaaaaacacacacacaaaagaaaatgtggcacatatacaccatggaatactctgcagccttaaaaaatgatgagttcttgtcctttgtagggagatggatgaagctggaaaccatcattctcagcaaactattgcaaaacaaaaaaccaaacatcgcatgttctcacttataggtgggaattgaacaataagaacacctggacacaggaagggggacatcacacaccagggcctgttgtggggtggggggaggagggagggatagcattaggacatatacctaatgtaaatgacgagttaatgggtgtagcacaccaacatggcacatgtatacatatgtaacaaacctgcacgttgtgtacatgtaccctagaacttaaagtataattaaaaaaaataaactatttaacagaggctgccgtattactggggttttaccacaggctaaccaatatgctagaaggaaaatacccaactccaggtccttctaacctgtgtcacacctatgtgggggtgggcaggggatgttaagaagctctttgaaggttgcagtccaagaacacatgctggcaaatagattcagaccaatttgtaggactatagaatgatttctctcccttccacactgacaaacacattaaaatatctcatgtatgataacagaggatgcacatggaaggatgacaagcctcaaatcctgtttaacaatgaatctgtagaaaagccaaagataacagaggacacaaaaataagaacactagagcaaattatggcctctgacatcagaggtaaaactagcgataaacatagcctaacacataaacataaacttcacactaaacgcctgtttatctttacctaacacatcatgtaaattatggtaagaattgtatccccacagactcatatattgaagtcatacccccaactatctcagaatgtacccttatttggaaataggaccattgcagatgtaattagttaattgaagatgagaacatactctagtagaaagtgtccctaatccaatatgattgaagaaaaagtagtaacaacatattttaatgagtcatatactattgaaacagagaaaacagtccagcacgcactgaactcaattttgatgtatacagagttgacgatcattttaaacttgacgaaactctagccagggtcttctgagccttctcaattcagccttaactttggtctataaaaacttgaaaaagacaggaacatagttggtaacagttcaagtctacatctctagaacgaacgacccagtctcccttaaagtgaactgtctgagaaaactgaaacctgcctgtcttcatggttcctataacaaaaataccatggccttacacaacacttatttctcacatttccacagattggaaagtccacaataaaggtgccagccagtttggtctgtaaggacccattttctgatttatagagcatggtcttcttgctgtgccctcacatggcagaagaggcaagaaagctctctggagtctcttttatgaggtcactaaggccattcatgagttcatcactcatgatctaatcaacccccaaagacttcctctcccaatatcatcacattggggtttaagatttcaacatataacttatgtaagtacacagacaatctatagcatgcttgtcccagccaagacttgaagataggcctggtgtctcctgacctctgtgggagggtagaagcccaacatcagcaagtatcagttaacaaagcaaatgggtttcacaggaaccaactccccccttctcacgatttgtaatttctcacatccctgaccctcctgagcccccactaactcccatttctctttcctcaaactccctttaacattttcctcaacctggatacatcaaagttaagttcatgctgaactcttgcctgtttcaatagtatatgactagttaaagcacgttcttacctctttaaccagttttccattttgtttgtcttgacagttatctggcactggaactcaaatccagattggaacccttatctggcccttggacaaaacagtcaatcctttctgcatgcgtagaaacctttgtctgatcttcagttgacttacttttttgggtatttggtggcgagttcaacttctggcctaacactgtgtagaaatttgcactgaggcatggcgaggacatattttcttcctatgtttctggctgtagtctctaaggctgggttataattccaggctgcttttgaaagacatctcctgggctggctgtttatcttcctggctccctgttttcagtgggaattcacttcctaactcctgtgctggaatgttcactctggcttcttgtgagacctcttcattctatttgaacttactcttcccacaggaactccacagttaaaccccttttgggttcctactctctatatatactatgacactaaccatgtctgcttctattttaggcaaaatgactttactgtggataattcggaactgcaatggtttatttgaaaatcttaagatctgcctaaagtggctcttataggactgctcccttcccatttccttcttttttccttctttcttttaccatcttaactttttccattgaactcccctgacactttgatatgcacctcttttccattaaacacccctgacttttgatatatacccatccttttacccctaccagatgtttcacttacctctttagcccctcgactccctatagtcactggaacgtatgcctcctgattcacagggggttctcgagagactgatgcacacacaaagcaacacacggggcttcctggaaacagagatataatctacagcctgtgtaagattacattttaggtgaaaaacccacaaataccccaaaatatgttactaattaaaatctgtcctcactaccttaaccagtgtctgggctttacctttgaaactggtgtccttatttaaaaaaagttggacatgcacccaggaatattatcttttgaagataaaggaatagattgaagtaatgctacttcaagccaaggaatgccaaaggttgtcatcaaactaccagaatgctatggtacgcatagcaaatgaatacatcagctttcaacaacatcatcaaaaattacaagtcatggtagcaggcaaaaaatatgctttaaaaagaaaaacaaaattagaaaaggacttggacatggcaagccaatcatgtgatttcttgatgtttcttctgtgttttctgcctagaaaaacccactgcactcactgctgggtggatctatctgaacctcttatggctctgagtgccatctgaaaaagatgatggttccctttaccttgagtcgttttccccagatacactagaacccattatttcagttcttttaggtctcttctgtgctattcgattatcagaaaagatttcaatgaccaatgaataaaaatgactgatctgtcccttatgctgtcttatttttcttcataaaattaacaatcttgaacatattttttacaattgtttctcttttccacaatatagtgtcatattaataagatgagacattttgctcatttttatcactgctgtgtgctgaaagcctaacacagtggtagccccaaagtagatgctcaaaaataaatatgctctgaatgagtatatttagtcatttcctggaaggagaggctgggtcaaacagagtgctaaggactcagaatccttactgctagaatgacaatgaaatgacagcatcatgttagtggcacatttaaaatgaaacaatatcaatattgaaaatatttgtaaggcttatttgaaaaaagaaaatcataacacatttacctataattcagaaatttaaatttctagataatttctaagattaaggttttttaatttcttaaacttttagataaccattttaaagaatatatattgtatatatctctgttattaaaaagtaattgaaagtaattacttcatattatattaaggcattatagctataaatatggtgtaaactgtaatggttattctgccctttcttctcttgctacctcctgccatcctaagagaagttgccttaagcagaattgtctcatcccgatccccagaatcactctatccactcacacattatctttcccaagcttgaggaaaaaataacagagtgagagacgaagattatgtattattattgcgactcttggtgtttgcaaaattccaaaatactgagatatggctaaataaaattctatgcaacttcttttgaatgcatgaatgtatatatttatgtaagttttattttgtttacattttgttttggtaattagagttttatttcccttggtgacagaactttctgttgtctttcagatgagtatatttttgattttgatttaaatataatttcccaaaataaacatttttgacttatacctattttatgttttttatgatgtcaagtccatggcatttgttcagggcgagactttaatgactgaacttcatgattatctttctacttgccaaacacttcatttatctttcccattattcaagagctgctatatccttgagtttgatattctttatctggaattcaatgcaaagctctgctaagtggtcatgatgatccaagagtggatgttagaattctaggatgccacaggtctttctctttccataaatcttaaagtctgtaggtttatgaaagacagttttgtcacagccagttagattcatgggttagcattgtggtgtaaggaggtgaatataatgaatgaactcagcaatgaacaggttttctgatgccagaagaagttttccctgcgtgttctataggtcttgtgccgtgtatcaagtatttcttctcttgatctactgtgcaatgggtataaggtttcagtgacacaagatgaagtcctagagattggctgtgcagcaccgtgcctggagttcacagtactgaatcgtgcactgaaaaagtgtaagagggtaaatttcctgttaagtgctctcaccacactaaataaataaaatttatcatgagccaggcactgaactaagctcaggatatattatgatgaacaaatttagacatgacaaacgatctcaataaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgctttt
